United States Patent
Nasar et al.

(10) Patent No.: US 9,388,428 B2
(45) Date of Patent: Jul. 12, 2016

(54) **COMPOSITIONS AND METHODS RELATED TO VIRUSES OF THE GENUS *NEGEVIRUS***

(71) Applicants: Farooq Nasar, Albany, NY (US); Rodion V. Gorchakov, Houston, TX (US); Andrew D. Haddow, Springfield, MO (US); Robert B. Tesh, Galveston, TX (US); Hilda Guzman, Galveston, TX (US); Scott C. Weaver, Galveston, TX (US)

(72) Inventors: Farooq Nasar, Albany, NY (US); Rodion V. Gorchakov, Houston, TX (US); Andrew D. Haddow, Springfield, MO (US); Robert B. Tesh, Galveston, TX (US); Hilda Guzman, Galveston, TX (US); Scott C. Weaver, Galveston, TX (US)

(73) Assignee: The Board of Regents of the University of Texas System, Austin, TX (US)

( * ) Notice: Subject to any disclaimer, the term of this patent is extended or adjusted under 35 U.S.C. 154(b) by 0 days.

(21) Appl. No.: 14/086,533

(22) Filed: Nov. 21, 2013

(65) Prior Publication Data
US 2014/0227765 A1   Aug. 14, 2014

Related U.S. Application Data

(60) Provisional application No. 61/729,317, filed on Nov. 21, 2012.

(51) Int. Cl.
*C12N 15/86* (2006.01)
*C07K 14/005* (2006.01)

(52) U.S. Cl.
CPC ............. *C12N 15/86* (2013.01); *C07K 14/005* (2013.01); *C12N 2770/00021* (2013.01); *C12N 2770/00043* (2013.01)

(58) Field of Classification Search
None
See application file for complete search history.

(56) References Cited

PUBLICATIONS

Vasilakis et al. Negevirus: a Proposed New Taxon of Insect-Specific Viruses with Wide Geographic Distribution. Journal of Virology 2013, 87: 2475-2488.*

Samina et al. Isolation of viruses from mosquitoes of the Negev, Israel. Transactions of the Royal Society of Tropical and Hygiene (1986), 80, 471-472.*

Glaser et al. The native Wolbachia endosymbionts of *Drosophila melanogaster* and Culex quinquefasciatus increase host resistance to West Nile virus infection. PLoS ONE 5:e11977 (2010).

Hoshino et al. Genetic characterization of a new insect flavivirus isolated from *Culex pipiens* mosquito in Japan. Virology 359, 405-414 (2007).

Igarashi et al. Morphological, biochemical, and serological studies on a viral agent (CFA) which replicates in and causes fusion of Aedes albopictus (Singh) cells. Virology 74, 174-187 (1976).

Locali-Fabris et al. Complete nucleotide sequence, genomic organization and phylogenetic analysis of Citrus leprosis virus cytoplasmic type. J. General Virology 87, 2721-2729 (2006).

Marklewitz et al. Gouleako virus isolated from West African mosquitoes constitutes a proposed novel genus in the family Bunyaviridae. J Virol 85, 9227-9234 (2011).

Moreira et al. A Wolbachia symbiont in Aedes aegypti limits infection with dengue, Chikungunya, and Plasmodium. Cell 139,1268-1278 (2009).

Nasar et al. Eilat virus, a newly identified host restricted alphavirus. Proceedings of the National Academy of Sciences of the United States of America (2012).

Rancès, E., Y. H. Ye, M. Woolfit, E. A. McGraw, and S. L. O'Neill. The relative importance of innate immune priming in Wolbachia-mediated dengue interference. PLoS pathogens 8:e1002548 (2012).

Sarver et al. Sindbis virus-induced cytopathic effect in clones of Aedes albopictus (Singh) cells. Virology 80:390-400. (1977).

Kuno, G. A survey of the relationships among the viruses not considered arboviruses, vertebrates, and arthropods. Acta Virol. 48(3), 135-43 (2004).

Stollar, V., V. Thomas. An agent in the Aedes aegypti cell line (Peleg) which causes fusion of Aedes albopictus cells. Virology. 64(2):367-77 (1975).

Pascon et al. The complete nucleotide sequence and genomic organization of Citrus Leprosis associated Virus, Cytoplasmatic type (CiLV-C). Virus Genes. Jun. 2006;32(3):289-98.

Kuno, G. A survey of the relationships among the viruses not considered arboviruses, vertebrates, and arthropods. Acta virologica 48, 135-143 (2004).

* cited by examiner

*Primary Examiner* — Nick Zou
(74) *Attorney, Agent, or Firm* — Norton Rose Fulbright US LLP

(57) ABSTRACT

Certain embodiments are directed to Negevirus and their polynucleotides and polypeptides.

8 Claims, 11 Drawing Sheets

A

B

C

D

E

| Identity Scores (%) / Nucleotide Identity Scores (%) | Negev M30957 | Negev M33056 | Negev EO 239 | Ngewotan | Piura | Loreto PeAR 261277 | Loreto PeAR 261777 | Loreto 394083 | Dezidougou | Santana | CiCLV | CiCLV DQ157466 | CiCLV Panama |
|---|---|---|---|---|---|---|---|---|---|---|---|---|---|
| Negev_M30957 | 100 | 99.9 | 95.6 | 70.6 | 59 | 48.5 | 48.5 | 48.5 | 35 | 34.3 | 32.7 | 32.7 | 32.6 |
| Negev_M33056 | 100 | 100 | 95.6 | 70.6 | 59.1 | 48.5 | 48.5 | 48.5 | 35.1 | 34.3 | 32.7 | 32.7 | 32.6 |
| Negev_EO 239 | 98.6 | 98.6 | 100 | 70.7 | 58.9 | 48.4 | 48.4 | 48.4 | 35 | 34.4 | 32.6 | 32.5 | 32.5 |
| Ngewotan | 79.1 | 79.2 | 79.1 | 100 | 58.9 | 48 | 48 | 48 | 35.5 | 34.7 | 33.3 | 33.4 | 33.3 |
| Piura | 60.6 | 60.5 | 60.5 | 60.9 | 100 | 47.1 | 47.1 | 47.1 | 34.2 | 34 | 32.7 | 32.8 | 32.8 |
| Loreto_PeAR261277 | 42.7 | 42.6 | 42.6 | 42.5 | 40.6 | 100 | 100 | 100 | 35.5 | 35.3 | 34 | 34 | 34 |
| Loreto_PeAR261777 | 42.7 | 42.6 | 42.6 | 42.5 | 40.6 | 100 | 100 | 100 | 35.5 | 35.3 | 34 | 34 | 34 |
| Loreto_394083 | 42.7 | 42.6 | 42.6 | 42.5 | 40.6 | 100 | 100 | 100 | 35.5 | 35.3 | 34 | 34 | 34 |
| Dezidougou | 21.4 | 21.4 | 21.3 | 21.6 | 21.1 | 21.9 | 21.9 | 21.9 | 100 | 55.9 | 31.9 | 31.9 | 31.9 |
| Santana | 20.6 | 20.5 | 20.3 | 20.5 | 20 | 21.2 | 21.2 | 21.2 | 52.6 | 100 | 31.2 | 31.3 | 31.3 |
| CiCLV | 19.5 | 19.6 | 19.5 | 20 | 19.2 | 19.4 | 19.4 | 19.4 | 18 | 16.9 | 100 | 99.5 | 99.4 |
| CiCLV_DQ157466 | 19.5 | 19.5 | 19.5 | 20 | 19.2 | 19.4 | 19.4 | 19.4 | 17.9 | 16.9 | 99.7 | 100 | 99.3 |
| CiCLV_Panama | 19.5 | 19.5 | 19.5 | 20 | 19.3 | 19.5 | 19.5 | 19.5 | 17.9 | 16.9 | 99.5 | 99.5 | 100 |

FIG. 7

COMPOSITIONS AND METHODS RELATED TO VIRUSES OF THE GENUS *NEGEVIRUS*

STATEMENT REGARDING FEDERALLY FUNDED RESEARCH

This invention was made with government support under N01-AI-30027 and HHSN272271000040I/HHSN2720004/D04 awarded by the NIH/NIAID. The government has certain rights in the invention.

PRIORITY PARAGRAPH

This application is a non-provisional application of U.S. Provisional Patent application 61/729,317 filed Nov. 21, 2012, which is incorporated herein by reference in its entirety.

REFERENCE TO SEQUENCE LISTING

A sequence listing required by 37 CFR 1.821-1.825 is being submitted electronically with this application. The sequence listing is incorporated herein by reference.

BACKGROUND

During the past decade, a growing number of novel insect-specific viruses have been detected in naturally infected mosquitoes. The term "insect-specific" was initially used to describe viruses in the genus *Flavivirus* (Flaviviridae) that replicate in mosquito cells but not in vertebrate cells. Although the insect-specific flaviviruses share the same genome organization and numerous amino acid motifs with the vertebrate flaviviruses, they do not infect vertebrates nor participate in the classical arthropod-vertebrate transmission cycle of arboviruses (Kuno, 2004, *Acta virologica* 48:135-143). *Culex flavivirus* (CxFV) and cell fusing agent virus (CFAV) are probably the best-known members of the insect-specific flavivirus group (Hoshino et al., 2007, *Virology* 359: 405-414; Igarashi et al., 1976, *Virology* 74:174-187; Stollar and Thomas, 1975, *Virology* 64:367-377). Recently, an increasing number of non-flaviviral RNA viruses (negeviruses, bunyaviruses, alphaviruses, nidoviruses and reoviruses) have been isolated from pools of field-collected mosquitoes, suggesting that these types of agents are quite common in nature (Marklewitz et al., 2011, *J Virol* 85:9227-9234; Nasar et al., 2012, *Proc Nat Acad Sci USA* 109(36):14622-7, Epub 2012 Aug. 20; Nga et al., 2011, *PLoS pathogens* 7:e1002215; Quan et al., 2010, *Virus research* 147:17-24; Yamao et al., 2009, *Archives of virology* 154:153-158; Zirkel et al., 2011, *mBio* 2:e00077-00011).

There remains a need to identify additional viruses, as well as characterize and genetically engineer Negevirus for the benefit of mankind.

SUMMARY

Certain embodiments described herein are directed to methods and compositions related to a novel group of insect-specific viruses, members of the genus Negevirus, that were isolated from mosquitoes and sandflies collected in Brazil, Peru, USA, Ivory Coast, Israel, and Indonesia.

In particular embodiments, the invention concerns isolated Negevirus nucleic acids, isolated Negevirus polypeptides, recombinant vectors incorporating Negevirus nucleic acid sequences and methods of using the same. The term "recombinant" may be used in conjunction with a polynucleotide or polypeptide, and generally refers to a polynucleotide or polypeptide produced from a nucleic acid molecule that has been manipulated or engineered in vitro or that is the replicated product of such a molecule.

Embodiments include expression vectors engineered from Negevirus nucleic acid sequence. In certain aspects the Negevirus expression vector comprises, one or more of a 5' cap, 5'UTR, ORF1, ORF2, ORF3, 3'UTR, 3' polyadenylate segment, and heterologous nucleic acid. A Negevirus expression vector may or may not include the 5'cap. In certain embodiments, the 5'UTR of a Negevirus is included in a recombinant expression vector. A heterologous nucleic acid is a nucleic acid segment that is not encoded by the virus as isolated from nature or contains a coding region in a position, form, or context that is not naturally found in a virus.

In certain embodiments the heterologous nucleic acid can be positioned immediately 3' to ORF1, ORF2, ORF3, or the 5'UTR. In certain aspects the Negevirus expression vector comprises, 5' to 3': a 5' cap, 5'UTR, ORF1, ORF2, heterologous nucleic acid, and 3'UTR. In another aspect, the Negevirus expression vector comprises, 5' to 3': a 5'UTR, ORF1, ORF2, heterologous nucleic acid, and 3'UTR. In certain aspects, the Negevirus expression vector comprises, 5' to 3': 5'UTR, ORF1, heterologous nucleic acid, and 3'UTR. In certain aspects, the Negevirus expression vector comprises, 5' to 3': 5'UTR, heterologous nucleic acid, and 3'UTR. A Negevirus expression vector can further comprise an endogenous or heterologous polyadenylation site or polyadenylate segment 3' to the 3'UTR.

Certain aspects include a helper vector expressing one or more of ORF1, ORF2 and ORF3 polypeptides, or other polypeptides that may be needed to propagate the various expression vectors lacking one or more of ORF1, ORF2, and ORF3. The helper vector will express one or more polypeptides needed for Negevirus packaging, replication, and/or propagation.

In certain embodiments, one or more of ORF1, ORF2, and ORF3 can be replaced by a nucleic acid segment encoding a heterologous nucleic acid. In certain aspects the heterologous nucleic acid encodes a heterologous viral protein (e.g., viral structural proteins other than Negevirus structural proteins). In certain embodiments the heterologous nucleic acid can encode one or more antigens. The antigen can be a cancer antigen or a microbial antigen. In certain aspects the microbial antigen is a bacterial or a viral antigen.

In certain aspects heterologous nucleic acid expression is under the control of an endogenous Negevirus promoter. In still a further aspect, heterologous nucleic acid expression is under the control of a heterologous promoter. The heterologous nucleic acid can express a target RNA. The target RNA can function as an RNA or be translated into an encoded polypeptide(s). In certain aspects an RNA can be an inhibitory RNA or oligonucleotide such as a miRNA, siRNA, or an antisense oligonucleotide.

In certain aspects the heterologous nucleic acid encodes an insecticidal RNA, peptide, or polypeptide.

Certain aspects are directed to recombinant expression vectors comprising all or part of a nucleic acid sequence that is 90, 91, 92, 93, 94, 95, 96, 97, 98, 99, 100% identical to SEQ ID NO: 1, 2, 3, 4, 6, 7, 8, 9, 11, 12, 14, 15, 16, 17, 19, or 20. In certain aspects the expression vector comprises 10, 500, 1000, 1500, 2000, 2500, 3000, 3500, 4000, 4500, 5000, 5500, 6000, 6500, 7000, 7500, 8000, 8500, 9000, 9500, 10000, 10500, 11000 consecutive nucleotides of that are at least 90, 91, 92, 93, 94, 95, 96, 97, 98, 99, 100% identical to SEQ ID NO: 1, 2, 3, 4, 6, 7, 8, 9, 11, 12, 14, 15, 16, 17, 19, or 20. In certain aspects a variant nucleotide sequence retains its function as a Negevirus. In other aspects the replication of Negevirus is attenuated in a Negev virus variant.

Embodiments also include methods of controlling an insect population by contacting insects with a Negevirus expression vector that express an insecticidal protein or nucleic acid. In certain aspects a recombinant virus as described herein can be dispersed in an environment to control insects, such as mosquitoes. In one aspect a virus can be disperse in a pond or standing water.

Certain embodiments are directed to isolated nucleic acid segments and recombinant vectors incorporating Negevirus nucleic sequences. In certain aspects the Negevirus nucleic acid sequences encode a polypeptide or peptide that includes within its amino acid sequence a contiguous amino acid sequence in accordance with, or essentially corresponding to one or more Negevirus polypeptide or segment thereof, including but not limited to SEQ ID NO:5, 10, 13, 18, or 21, or other polypeptide(s) encoded by SEQ ID NO:1, 2, 3, 4, 6, 7, 8, 9, 11, 12, 14, 15, 16, 17, 19, or 20.

In certain aspects an isolated nucleic acid has a nucleotide sequence that is 90, 91, 92, 93, 94, 95, 96, 97, 98, 99, or 100% identical to SEQ ID NO: 1, 3, 6, 7, 8, 11, 14, 15, 16, or 19.

The term "isolated", when used in relation to a nucleic acid molecule or sequence, refers to a nucleic acid sequence that is identified and separated from at least one contaminant nucleic acid with which it is ordinarily associated with in nature. Isolated nucleic acids are nucleic acids present in a form or setting that is different from that in which it is found in nature. In an embodiment, an isolated nucleic acid is substantially free of cellular material or culture medium when produced by recombinant DNA techniques; or chemical precursors, or other chemicals when chemically synthesized.

In certain aspects the recombinant nucleic acids are from a Negev virus (SEQ ID NO:3, 6, or 7), Piura virus (SEQ ID NO:8), Loreto virus (SEQ ID NO:11, 14, or 15), Dezidougou virus (SEQ ID NO:16), or Santana virus (SEQ ID NO19). Further embodiments are directed to recombinant nucleic acids comprising all or part of a nucleic acid sequence that is 90, 91, 92, 93, 94, 95, 96, 97, 98, 99, 100% identical to SEQ ID NO: 1, 2, 3, 4, 6, 7, 8, 9, 11, 12, 14, 15, 16, 17, 19, or 20. In certain aspects a Negevirus has a consensus sequence of SEQ ID NO:1.

In certain aspects the Negevirus specific nucleic acids are Negevirus specific oligonucleotides of 10, 11, 12, 13, 14, 15, 16, 17, 18, 19, 20, 21, 22, 23, 24, 25, 26, 27, 28, 29, 30, 35, 40, 45, 50, 55, 60, 70, 80, 90, 100 consecutive nucleotides of SEQ ID NO: 1, 2, 3, 4, 6, 7, 8, 9, 11, 12, 14, 15, 16, 17, 19, or 20. In certain aspects the oligonucleotides are Negevirus specific oligonucleotide primers and/or oligonucleotide probes. As used herein, the phrase "Negevirus specific" means the ability of a nucleic acid molecule to recognize a nucleic acid sequence complementary to its own and to form double-helical segments through hydrogen bonding between complementary base pairs and at a level that can be distinguished from random or non-specific association.

Certain embodiments are directed to polypeptides and segments thereof encoded by a nucleic acid that is 90, 91, 92, 93, 94, 95, 96, 97, 98, 99, 100% identical to SEQ ID NO:5, 10, 13, 18, or 21. In certain aspects the polypeptide comprising about or at least 5, 10, 20, 30, 40, 50, 60, 70, 80, 90, 100, 200, 300, 400, 500, 600, 700, 800, 900, 1000, 1100, 1200, 1300, 1500, 1600, 1700, 1800, 1900, 2000, 2100, 2200, 2300, 2400, 2500 consecutive amino acids, including all values and ranges there between, of SEQ ID NO:5, 10, 13, 18, or 21. Further aspects include polypeptide fragments including amino acids 1, 10, 20, 30, 40, 40, 50, 60, 70, 80, 90, 100, 200, 300, 400, 500, 600, 700, 800, 900, 1000, 1100, 1200, 1300, 1500, 1600, 1700, 1800, 1900, 2000, 2100, 2200, 2300, 2400 to 10, 20, 30, 40, 40, 50, 60, 70, 80, 90, 100, 200, 300, 400, 500, 600, 700, 800, 900, 1000, 1100, 1200, 1300, 1500, 1600, 1700, 1800, 1900, 2000, 2100, 2200, 2300, 2400, 2500, including all ranges there between. In certain aspects the polypeptide is an isolated or purified polypeptide. As used herein, the term "purified" or "to purify" refers to the removal of undesired components from a sample. In certain embodiments a polypeptide as described herein is coupled to a heterologous moiety.

Further embodiments are directed to methods for producing an antibody that specifically binds a Negevirus comprising inducing an immune response in a mammal by providing a Negevirus polypeptide to the mammal and isolating Negevirus specific antibody from the mammal. As used herein, the phrase "specifically binds" refers to the ability of an antibody to bind an amino acid sequence or structure at a level that can be distinguished from random, background, or non-specific binding.

Still further embodiments are directed to antibodies that bind a polypeptide encoded by a nucleic acid that is 90, 91, 92, 93, 94, 95, 96, 97, 98, 99, 100% identical to SEQ ID NO: 5, 10, 13, 18, or 21. In certain aspects the antibody is an isolated or purified antibody. An antibody can specifically bind a Negevirus polypeptide. In certain aspects the presence of a Negevirus polypeptide can be detected by the binding of an antibody that specifically binds Negevirus.

Yet further embodiments are directed to methods for producing a Negevirus comprising introducing a Negevirus expression vector capable of producing a Negevirus into a host cell and incubating the host cell under conditions that produce Negevirus. In certain aspects the Negevirus is isolated or purified from the Negevirus producing host cell.

Certain embodiments are directed to methods for detecting a Negevirus comprising contacting a sample with a Negevirus specific reagent, measuring the binding or hybridization of the Negevirus specific reagent, and determining if the Negevirus specific reagent is specifically binding to the sample.

Further embodiments are directed to kits for producing and or detecting a Negevirus comprising a Negevirus specific antibody, peptide, nucleic acid, and/or oligonucleotide.

The following terms are used to describe the sequence relationships between two or more polynucleotides: "reference sequence", "sequence identity", "percentage of sequence identity", and "substantial identity". A "reference sequence" is a defined sequence used as a basis for a sequence comparison; a reference sequence may be a subset of a larger sequence, for example, as a segment of a full-length cDNA sequence given in a sequence listing or may comprise a complete gene sequence. Generally, a reference sequence is at least 20 nucleotides in length, frequently at least 25 nucleotides in length, and often at least 50 nucleotides in length. Since two polynucleotides may each (1) comprise a sequence (i.e., a portion of the complete polynucleotide sequence) that is similar between the two polynucleotides, and (2) may further comprise a sequence that is divergent between the two polynucleotides, sequence comparisons between two (or more) polynucleotides are typically performed by comparing sequences of the two polynucleotides over a "comparison window" to identify and compare local regions of sequence similarity. A "comparison window", as used herein, refers to a conceptual segment of at least 20 contiguous nucleotide positions wherein a polynucleotide sequence may be compared to a reference sequence of at least 20 contiguous nucleotides and wherein the portion of the polynucleotide sequence in the comparison window may comprise additions or deletions (i.e., gaps) of 20 percent or less as compared to the reference sequence (which does not comprise additions or deletions) for optimal alignment of the two sequences. Optimal alignment of sequences for aligning a comparison window may be conducted by the local homology algorithm of Smith and Waterman (Smith and Waterman, Adv. Appl. Math. 2: 482 (1981)) by the homology alignment algorithm of Needleman and Wunsch (Needleman and Wunsch, J. Mol. Biol. 48:443 (1970)), by the search for similarity method of Pearson and Lipman (Pearson and Lipman, Proc. Natl. Acad. Sci. (U.S.) 85:2444 (1988)), by computerized implementations of these algorithms (GAP, BESTFIT, FASTA, and TFASTA in the Wisconsin Genetics Software Package Release 7.0, Genetics Computer Group, 575 Science Dr., Madison, Wis.), or by inspection, and the best alignment (i.e., resulting in the highest percentage of homology over the comparison window) generated by the various methods is selected. The term "sequence identity" means that two polynucleotide sequences are identical (i.e., on a nucleotide-by-nucleotide basis) over the window of comparison. The term "percentage of sequence identity" is calculated by comparing two optimally aligned sequences over the window of comparison, determining the number of positions at which the identical nucleic acid base (e.g., A, T, C, G, U, or I) occurs in both sequences to yield the number of matched positions, dividing the number of matched positions by the total number of positions in the window of comparison (i.e., the window size), and multiplying the result by 100 to yield the percentage of sequence identity. The terms "substantial identity" as used herein denotes a characteristic of a polynucleotide sequence, wherein the polynucleotide comprises a sequence that has at least 85 percent sequence identity, preferably at least 90 to 95 percent sequence identity, more usually at least 99 percent sequence identity as compared to a reference sequence over a comparison window of at least 20 nucleotide positions, frequently over a window of at least 25 50 nucleotides, wherein the percentage of sequence identity is calculated by comparing the reference sequence to the polynucleotide sequence which may include deletions or additions which total 20 percent or less of the reference sequence over the window of comparison. The reference sequence may be a subset of a larger sequence, for example, as a segment of the full-length sequences of the compositions claimed in the present invention.

Moieties of the invention, such as polypeptides, peptides, antigens, or immunogens, may be coupled or linked covalently or noncovalently to other moieties such as adjuvants, proteins, peptides, supports, fluorescence moieties, or labels. The term "conjugate" or "immunoconjugate" is broadly used to define the operative association of one moiety with another agent and is not intended to refer solely to any type of operative association, and is particularly not limited to chemical "conjugation."

The term "providing" is used according to its ordinary meaning "to supply or furnish for use." In some embodiments, the protein is provided directly by administering the protein, while in other embodiments, the protein is provided by administering a nucleic acid encoding the protein. In certain aspects the invention contemplates compositions comprising various combinations of nucleic acid, antigens, peptides, and/or epitopes.

Other embodiments of the invention are discussed throughout this application. Any embodiment discussed with respect to one aspect of the invention applies to other aspects of the invention as well and vice versa. Each embodiment described herein is understood to be embodiments that are applicable to all aspects of the invention. It is contemplated that any embodiment discussed herein can be implemented with respect to a method or composition described, and vice versa. Furthermore, compositions and kits of the invention can be used to achieve methods described.

The use of the word "a" or "an" when used in conjunction with the term "comprising" in the claims and/or the specification may mean "one," but it is also consistent with the meaning of "one or more," "at least one," and "one or more than one."

Throughout this application, the term "about" is used to indicate that a value includes the standard deviation of error for the device or method being employed to determine the value.

The use of the term "or" in the claims is used to mean "and/or" unless explicitly indicated to refer to alternatives only or the alternatives are mutually exclusive, although the disclosure supports a definition that refers to only alternatives and "and/or."

As used in this specification and claim(s), the words "comprising" (and any form of comprising, such as "comprise" and "comprises"), "having" (and any form of having, such as "have" and "has"), "including" (and any form of including, such as "includes" and "include") or "containing" (and any form of containing, such as "contains" and "contain") are inclusive or open-ended and do not exclude additional, unrecited elements or method steps.

Other objects, features and advantages of the present invention will become apparent from the following detailed description. It should be understood, however, that the detailed description and the specific examples, while indicating specific embodiments, are given by way of illustration only, since various changes and modifications within the spirit and scope of the specification will become apparent to those skilled in the art from this detailed description.

DESCRIPTION OF THE DRAWINGS

The following drawings form part of the present specification and are included to further demonstrate certain aspects of the present invention. The invention may be better understood by reference to one or more of these drawings in combination with the detailed description of the specification embodiments presented herein.

FIG. 7. Cladistic tree showing the relationships between the viruses along with the nucleotide identity and the protein identity for the ORF1 of the nine viruses and the RNA species one of CiCLV. Alignments were performed as proteins and then toggled back to nucleotide. The branch lengths of the tree do not reflect genetic distance but have the same topology as the trees found in FIG. 3 and FIG. 4.

DESCRIPTION

The inventors describe a novel group of insect-specific viruses occurring in mosquitoes and phlebotomine sandflies distantly related phylogenetically to citrus leprosis virus C (CiLV-C), genus Cilevirus, a mite-transmitted virus causing disease in citrus plants (Locali-Fabris et al., 2012, *Genus Cilevirus*, p. 1169-1172. In King, Adams, Carstens, and Lefkowitz (ed.), Virus Taxonomy. Ninth Report of the International Committee on Taxonomy of Viruses. Elsevier, San Diego; Locali-Fabris et al., 2006, *Journal of general virology* 87:2721-2729; Pascon et al., 2006, *Virus genes* 32:289-298). The inventors designate this new group of viruses as Negevirus.

I. Negevirus

Negevirus genomes consist of single stranded, positive sense RNA with a poly-A tail. By electron microscopy, the virions appear as spherical particles with diameters of ~45-55 nm (FIGS. 8A-8D). Based on their genome organization and phylogenetic relationship, the viruses (examples of which are designated Negev virus, Ngewotan virus, Piura virus, Loreto virus, Dezidougou virus, and Santana virus) appear to form a new taxon of Negevirus. The Negevirus viruses replicate rapidly and to high titer (up to $10^{10}$ PFU/ml) in mosquito cells, producing extensive cytopathic effect and plaques; but they do not appear to replicate in mammalian cells or mice. These viruses have one large open-reading-frame (ORF1) and two small ORFs, ORF2 and ORF3. The viruses appear to be nonsegmented, however they may package some mRNA. A prototype virus, Negev virus (SEQ ID NO:7), could not infect vertebrate cell lines. However, it could readily infect insect cells including mosquito cell lines encompassing three genera, as well as sandfly cells. Negev virus displayed extensive cytopathology 12 hpi and could be plagued on C7/10 cells (*Aedes albopictus*). Negev virus grew to high titers ($10^{10}$ pfu/mL) 48-hrs-post-infection in C7/10 cells.

Figure 11:
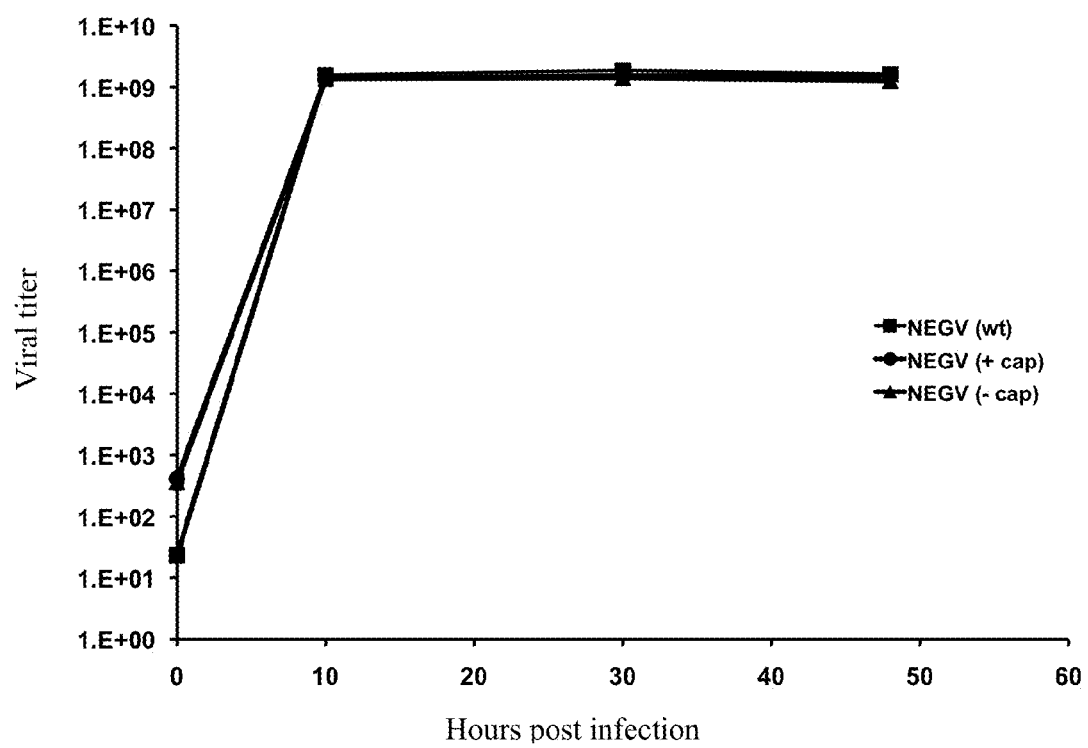
FIG. 11. Comparison of replication for cap+ and cap− Negevirus.
Figure 12:
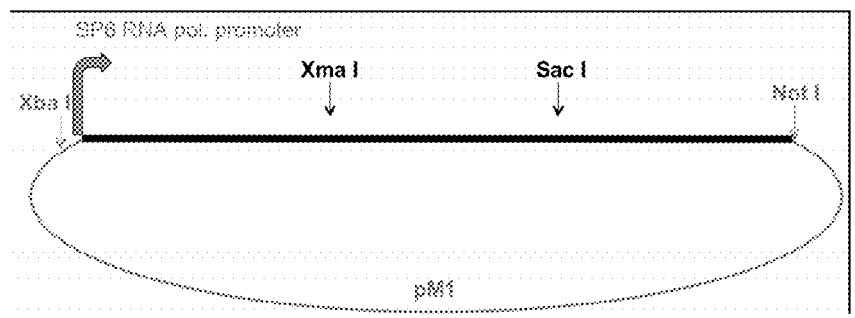
FIG. 12. Restriction map of plasmid pM1 encoding a Negevirus genome.
Figure 13:
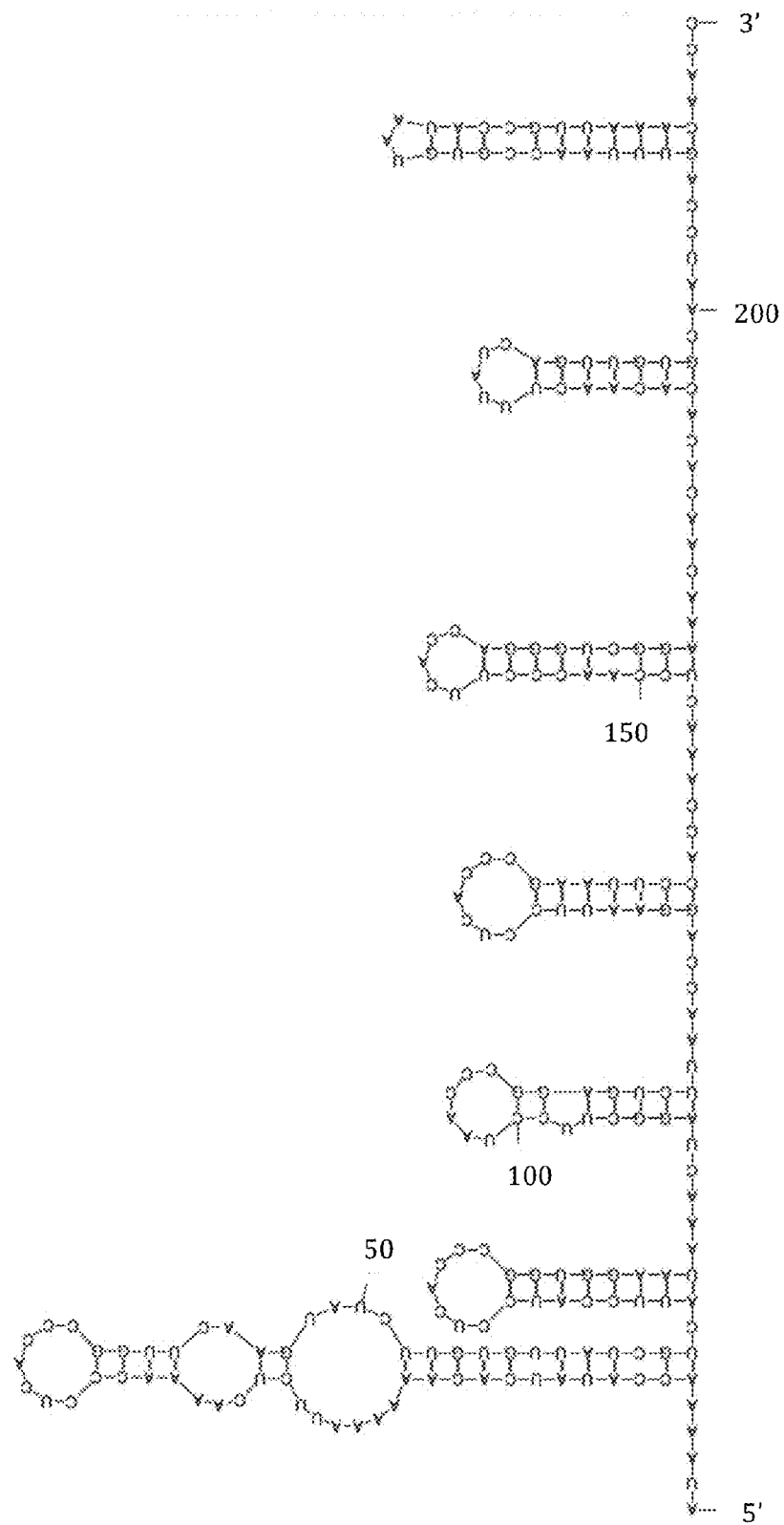
FIG. 13. Illustration of secondary structure of Negevirus 5'UTR.

A full-length infectious clone was generated using reverse genetics (FIG. 12). Interestingly, the virus could be rescued independent of the 5' cap with identical rescue efficiency to rescue with the addition of 5' cap (NEGV RNA+cap=titer of 9.0 $\log_{10}$ pfu/mL and NEGV RNA−cap=titer of 9.0 $\log_{10}$ pfu/mL) (FIG. 11). The 5' UTR may represent an IRES sequence that could facilitate the translation of the Negev virus genome (FIG. 13). The recombinant Negev virus displayed similar growth kinetics to wild-type virus and grew to high titers in insect cells. In vivo mosquito experiments showed that Negev virus was also able to replicate and cause disseminated infection in *Aedes aegypti* mosquitoes. The name, source, and geographic origins of viruses representative of the Negevirus group are listed in Table 1.

TABLE 1

| Virus Name | Strain Designation | Mosquito Species | Collection Locality | Collection Date |
|---|---|---|---|---|
| Negev | M30957 | *Culex coronator* | Harris Co., Texas, US | 2008 |
| Negev | M33056 | *Culex quinquefaciatus* | Harris Co., Texas, US | 2008 |
| Negev | E0329 | *Anopheles coustani* | Negev, Israel | 1983 |
| Piura | P60 | *Culex* sp. | Paja Piura, Peru | 1996 |
| Loreto | 3940-83 | *Anopheles albimanus* | Lima, Peru | 1983 |
| Loreto | Pe AR 2617/77 | *Lutzomyia* sp. | Iquitos, Loreto, Peru | 1977 |

TABLE 1-continued

| Virus Name | Strain Designation | Mosquito Species | Collection Locality | Collection Date |
|---|---|---|---|---|
| Loreto | Pe AR 2612/77 | *Culex* sp. | Iquitos, Loreto, Peru | 1977 |
| Dezidougou | ArA 20086 | *Aedes aegypti* | Dezidougou, Ivory Coast | ~1984 |
| Santana | BeAR 517449 | *Culex* sp. | Macapa, Amapa, Brazil | 1992 |

Genome Organization and Analysis.

Figure 1A:
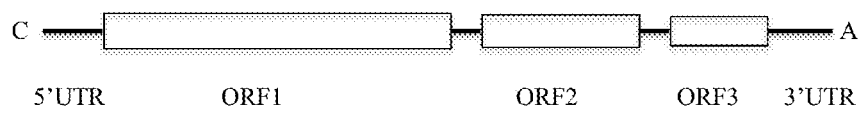
FIGS. 1A-1E. Negevirus constructs. (A)-(E) are diagrams of various Negevirus constructs. C=5'cap, A=polyadenylation site, ORF1=open reading frame 1, ORF2=open reading frame 2, ORF3=open reading frame 3, HNA=heterologous nucleic acid, 5'UTR=5' untranslated region, 3' UTR=3' untranslated region, and a line between boxes represents intragenic spacers.
Figure 1B:
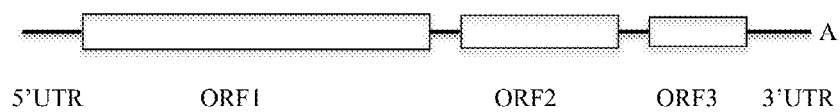
Figure 1C:
Figure 1D:
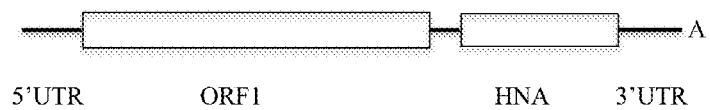
Figure 1E:
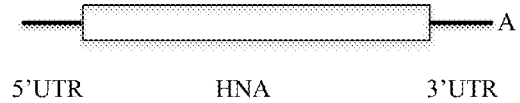
Figures 2A, 2B:
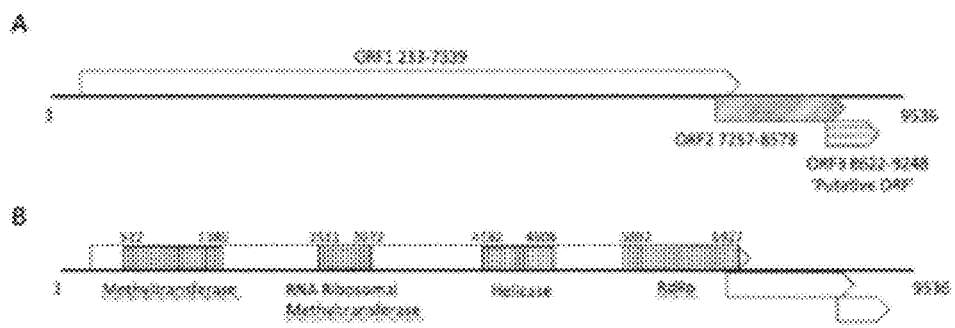
FIGS. 2A-2B. The genome organization and position of the open reading frames (A) for Negev E0239 (SEQ ID NO:7) and the conserved protein domains (B) again for Negev E0239. The viruses show similar genome organization and protein domains.
Figures 3A, 3B, 3C, 3D, 3E, 3F:
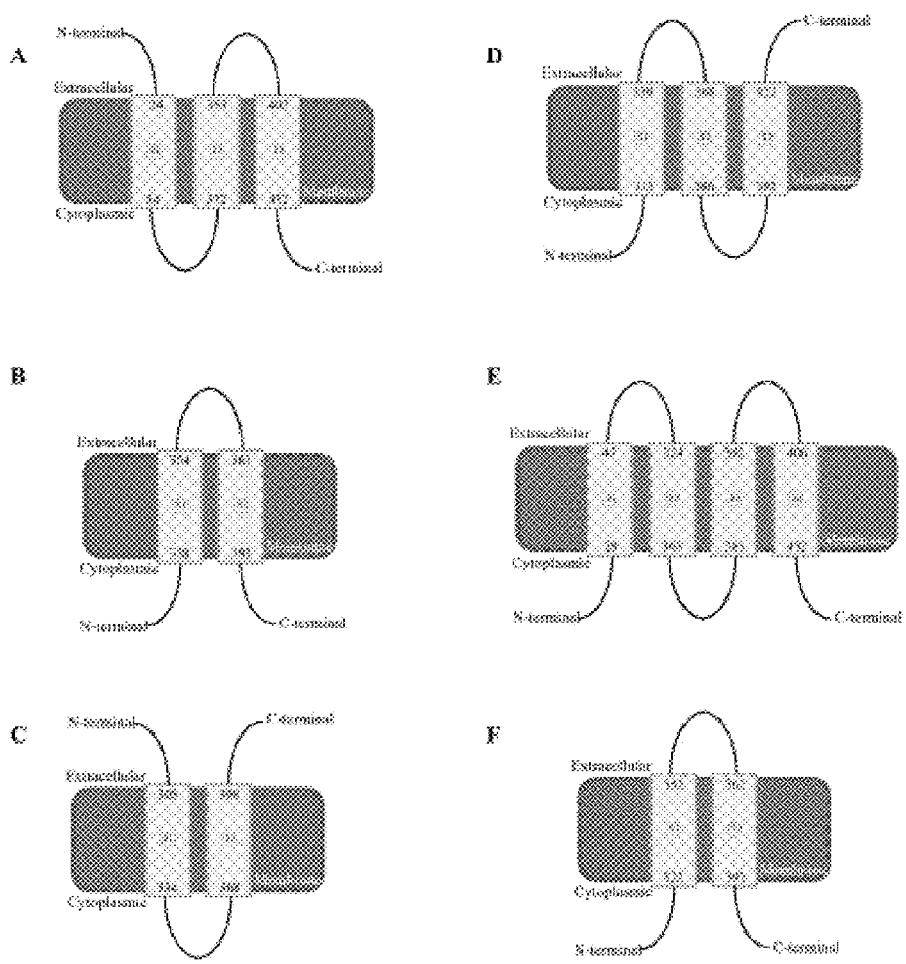
FIGS. 3A-3F. The predicted transmembrane domains and the orientation of the ORF2 by MAMSAT-SVM for (A) Negev virus, (B) Piura virus, (C) Loreto virus, (D) Dezidougou virus, (E) Santana virus and (F) Ngewotan virus FIG. 4. Analysis of genomic RNA of NEGV and PIUV labeled with [$^3$H]uridine in the presence of dactinomycin (ActD) for 12 hrs. Both viruses were purified via rate-zonal centrifugation. Viral RNA was analyzed by agarose gel electrophoresis. Lane 1=mock, 2=NEGV, 3=PIUV.
Figure 4:
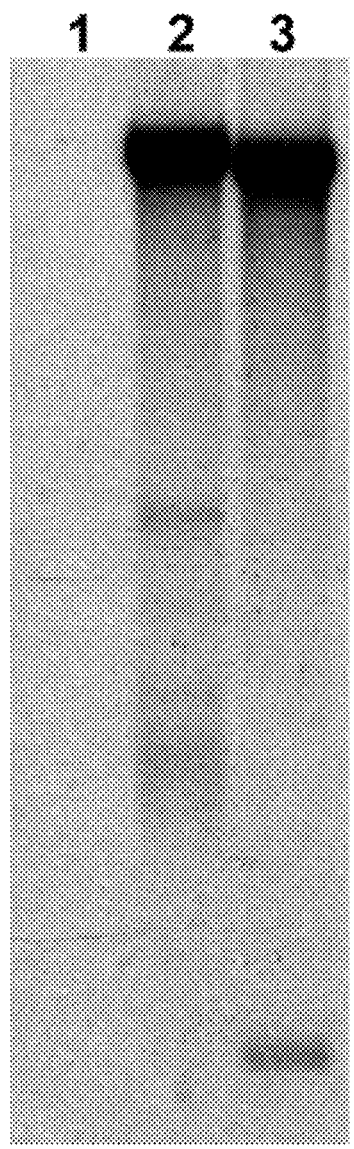
Figure 5:
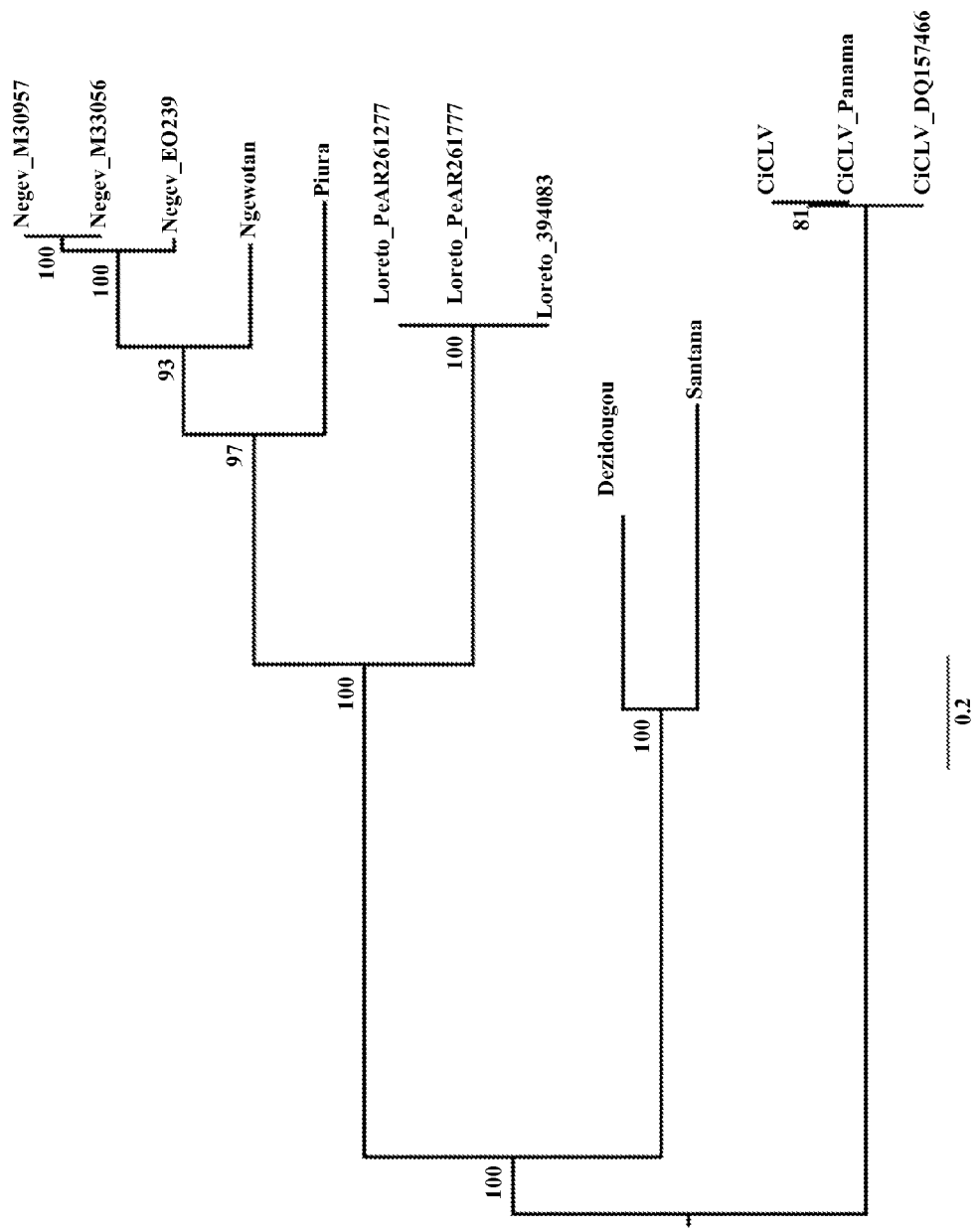
FIG. 5. Phylogenetic trees produced using Maximum likelihood methods of Negevirus genomes plus three genomes of CiCLV. The trees were rooted using the CiCLV viruses as an outgroup. The region of the genome corresponds to the nt 626-2908 of SEQ ID NO:7 (Negev E0329), which corresponds to the helicase region of the genome. The model used was the TrN+G model with 1000 bootstraps. Bootstraps are presented on the major branches.
Figure 6:
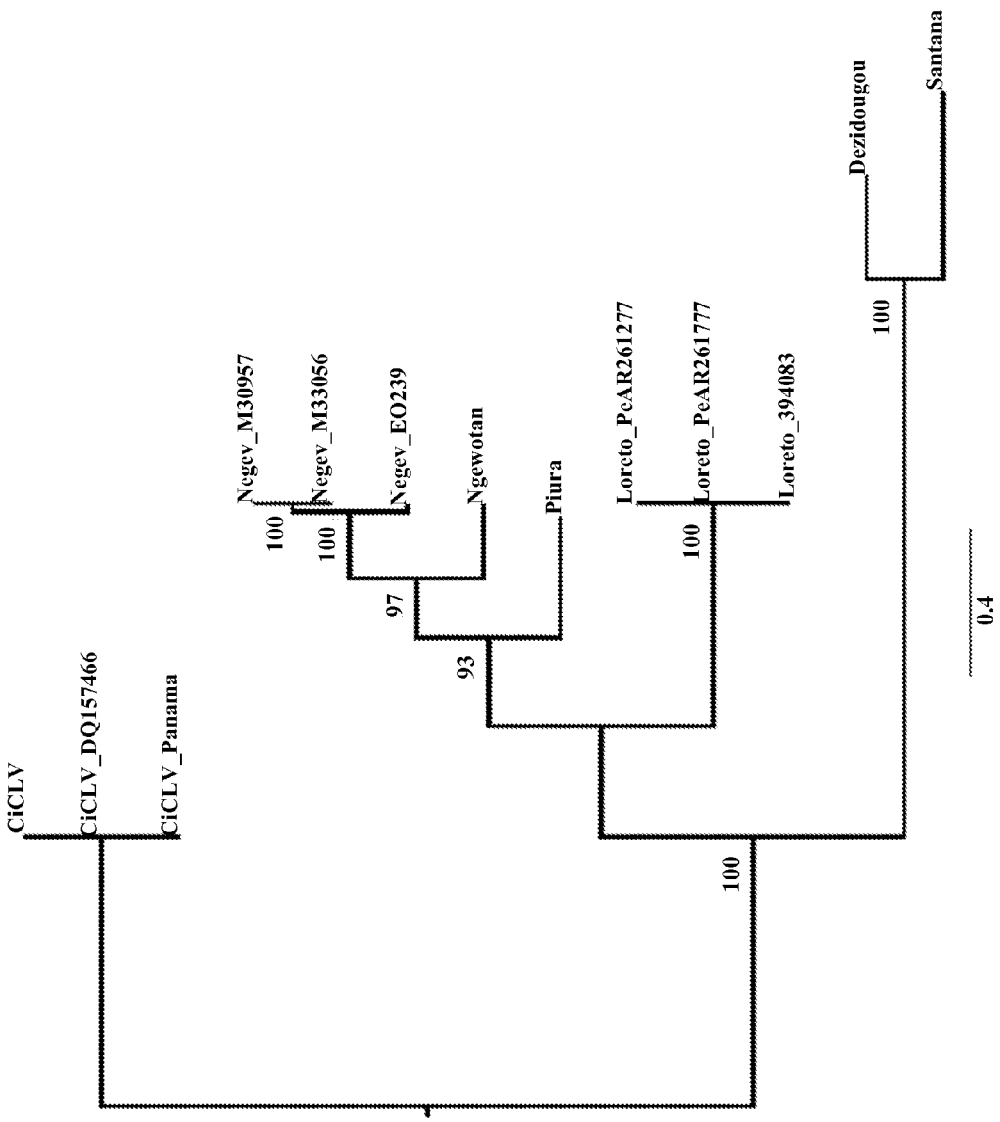
FIG. 6. Phylogenetic trees produced using Maximum likelihood methods of the Negevirus genomes plus three genomes of CiCLV. The trees were midpoint rooted. The region of the genome corresponds to nucleotides 4316-7309 of SEQ ID NO:7 (Negev E0329), which corresponds to the RNA-dependent RNA-polymerase of the genome. The model used was the GTR+G model with 1000 bootstraps. Bootstraps are presented on the major branches.
Figures 8A, 8B, 8C, 8D:
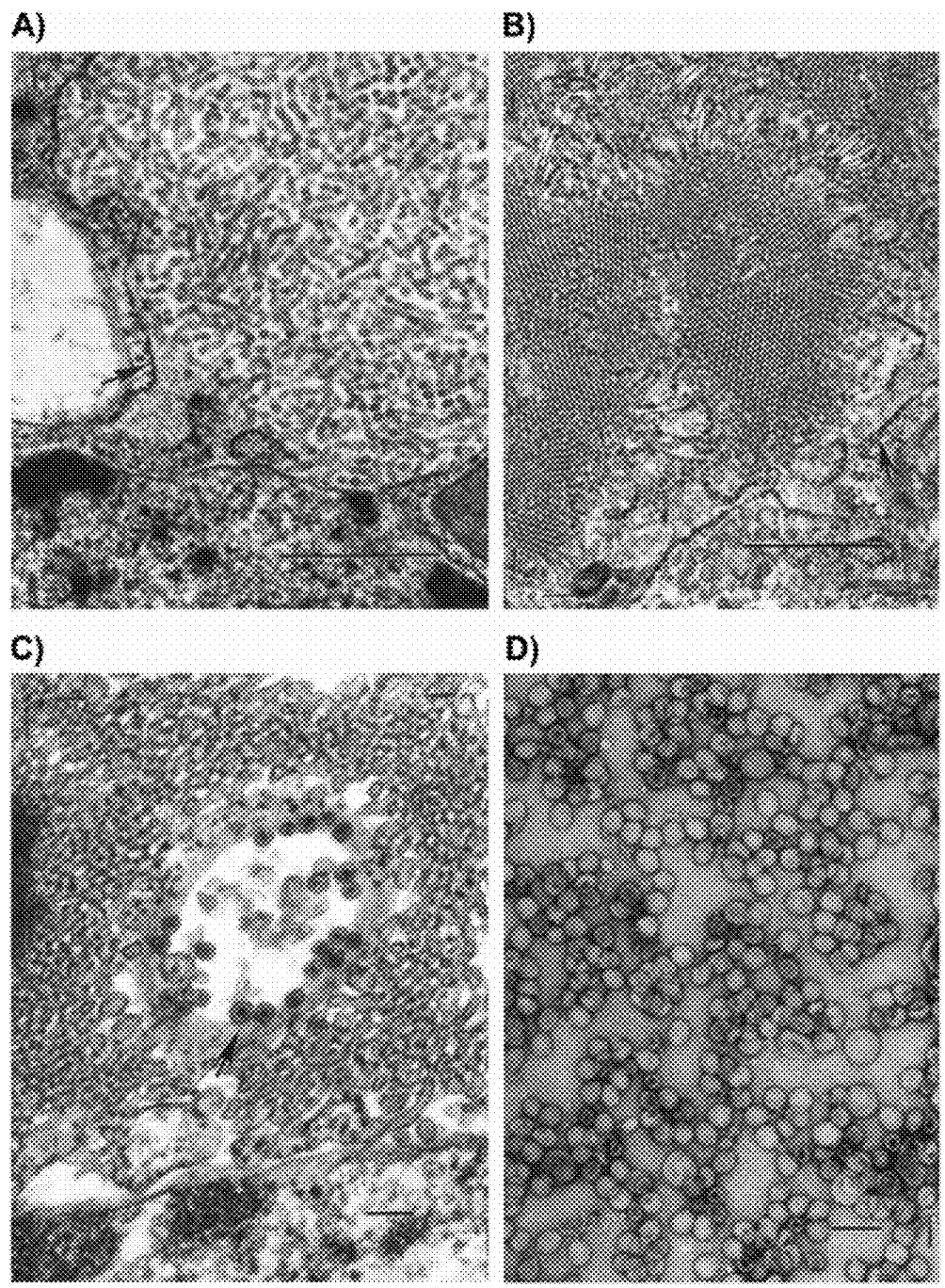
FIGS. 8A-8D. Transmission electron microscopy analysis of infected cells and purified suspensions. (A) Expanded perinuclear space (arrow indicates its membrane) of an *Ae. albopictus* C6/36 cell infected with Negev (E0329) virus is filled with microtubules 20 nm in diameter and up to 160 nm long. Bar=0.5 µm. (B) Portion of a tremendous perinuclear space-granular endoplasmic reticulum extension loaded with microtubules forming paracrystalline arrays in cross-sections in a C6/36 cell infected with ArA 20086 virus. The arrow indicates a limiting membrane with ribosomes at the outer surface. Bar=0.5 µm. (C) Cytoplasmic vacuole with spherules at its periphery (arrow) surrounded by microtubules in a perinuclear space of a C6/36 cell infected with ArA 20086 virus. Bar=100 nm. (D) Negatively stained (2% uranyl acetate) suspension of purified suspension of P60 virus contains mostly particles ~50 nm in diameter. Bar=100 nm.

The size of the positive sense, single-strand genomes of the representative viruses ranged in size from approximately 9 to 10 kilobases (kb) (SEQ ID NO:3, 6, 7, 8, 11, 14, 15, 16, and 19). Three open reading frames (ORFs) are flanked by untranslated regions (UTRs) at the 5' and 3' ends, while each ORF is separated by short intergenic regions. Using Negev virus strain E0329 as the prototype, the inventors determined that ORF1 and ORF2 encode the non-structural proteins and structural proteins, respectively. ORF prediction programs (EnzymeX, Aalsmeer, Netherlands) did not identify a function for ORF3.

5'- and 3'-UTRs.

The sequences of the 5'- and 3'-UTRs vary in length among these viruses, ranging in length from 72 to 730 nt and 121 to 442 nt long, respectively. For all viruses a polyadenylation tail is present in the distal sites of each genome, varying in length from 13-52 nt in length.

Open Reading Frames (ORF).

A large ORF was found starting at nt 233 to 7339 of SEQ ID NO:7. Two small ORFs were identified at the 3' end of the genome (FIG. 2A). The large ORF contains putative protein domains that correspond to non-structural proteins (FIG. 2B). Using the protein domain prediction software in the BLAST suite of programs four functional domains were identified: (i) a methyltransferase domain at nt 522-1386 of SEQ ID NO:7; (ii) an RNA ribosomal methyltransferase domain at nt 2511-3072 of SEQ ID NO:7; (iii) a helicase domain at nt 4182-4908 of SEQ ID NO:7; and (iv) an RNA-dependent RNA-polymerase domain (RdRp) at nt 5802-6927 of SEQ ID NO:7 (FIG. 2B). Using the PsiPRED server available at URL bioinfics.ucl.ac.uk/psipredll?program=psipred (Buchan et al., 2010, Nucleic acids research 38:W563-568), ORF2 was predicted to contain three transmembrane regions according to the algorithm prediction software MEMSAT-SVM (Jones, 2007, *Bioinformatics* 23:538-544; Jones et al., 1994, *Biochemistry* 33:3038-3049; Nugent and Jones, 2009, *BMC bioinformatics* 10:159), as depicted in FIG. 3A. The presence of these transmembrane regions suggests that this protein is contained within a viral envelope and may be a glycoprotein. Analysis of all ORF2s from Negev, Piura, Loreto, Dezidougou, Santana and Ngewotan viruses showed that all contained transmembrane helices (FIG. 3A-3F). However, the number and arrangement of these helices differed for all 6 viruses, suggesting a significant difference in the arrangement of the viral surface. For ORF3, no putative functions or domain homologies were identified. Short intergenic regions ranging from 14-44 nt and 21-175 long are intersecting the junctions of ORF1/ORF2 and ORF2/ORF3, respectively.

To confirm monosegmentation, monolayers of C7/10 cells were infected with Negev E0239 and Piura P60 viruses at a MOI of 10, in the presence of [$^3$H] uridine (20 μCi/ml). Viral RNA was isolated from purified virus and analyzed by agarose gel electrophoresis. The results showed an abundant large genomic RNA species as well as the presence of several less abundant smaller RNA species (FIG. 4).

Phylogenetic Analysis.

Alignments of the ORF1 were created for all of the virus sequences. As initial BLAST results had indicated that the nearest viral relative was the Citrus Leprosis C viruses (CiLV-C) (Locali-Fabris et al., 2006, *Journal of General Virology* 87:2721-2729), the ORF1 sequences of the newly identified sequences were aligned with the three full-length RNA sequences of CiLV-C present in GenBank. The sequences were first aligned as proteins and then toggled back to nucleotides. These alignments were run through the GUIDENCE algorithm, which shows the confidence in the alignment, to ensure that regions of the genome exhibited no more evidence of homology than random assembly of protein would show. Two regions of the ORF1, nt 626-2908 of SEQ ID NO:7 and nt 4316-7309 of SEQ ID NO:7, exhibited confidence levels sufficient to perform further phylogenetic analysis. Phylogenetic trees generated under maximum likelihood (ML) and Bayesian algorithms exhibited the same topology, and thus only the ML trees are shown (FIG. 5 and FIG. 6, respectively). Distinct viruses can be identified: Negev, Loreto, Ngewotan, Piura, Dezidougou, and Santana viruses. As the regions used to generate the phylogeny were highly conserved, the relationships presented in the trees do not necessarily reflect the diversity among the viruses. Therefore, a full-length alignment of the ORF1 polyprotein was used to determine similarities in nucleotide and protein sequence of these viruses (FIG. 7). The three Negev viruses and the three Loreto viruses exhibited nucleotide and protein identities between 95.6-100% and 98.6-100%, respectively. However, among the viruses represented in this study (excluding the (CiLV-C) the nucleotide identity ranged from 33.2-70.6% and the protein identity ranged from 20-79.2%. The 3 strains of the CiLV-C viruses were nearly identical but showed little similarity with the newly identified viruses with nucleotide identity ranging from 30.7-34.7% and protein identity ranging from 16.9-20.6%.

Ultrastructural Characteristics.

The most prominent ultrastructural characteristic of infected C6/36 mosquito cells was expansion of perinuclear spaces (FIG. 8A). These had a universal diameter of 20 nm. In some cells, the expansions were filled only with vesicles, in others also with microtubules so the vesicles appeared as cross-sections of the microtubules. These microtubules were up to 160 nm long and rarely even longer. In some cells, they formed paracrystalline arrays (FIG. 8B). Expanded perinuclear space filled with vesicles or tubules could occupy most of the cell volume, pushing the cytoplasm to the cell periphery as a thin rim.

The second peculiar feature of many of these viruses was the formation of cytoplasmic cytopathic vacuoles (CPVs), similar to those seen with alphaviruses, containing spherules ~50 nm in diameter at the inner surface of their limiting membrane. In alphavirus-infected cells, CPVs are modified endosomes and lysosomes in which translation, transcription, and assembly of viral nucleocapsids occurs (Froshauer et al., 1988, *Journal of Cell Biology* 107:2075-2086). Some CPVs reached a diameter of 1.4 µm and could be found in almost all viruses studied (Table 2) and sometimes among the microtubules of the expanded perinuclear space (FIG. 8C). In a negatively stained purified suspension of the Piura virus (P60), spherical particles with diameters of ~45 nm and ~55 nm were found (FIG. 8D).

TABLE 2

| Strain Designation | Presence of cytoplasmic cytopathic vacuoles (CPVs) | Expansion of perinuclear space |
| --- | --- | --- |
| M30957 | Yes | Yes |
| M33056 | Yes | Yes |
| E0329 | Yes | Yes |
| P60 | Yes | Yes |
| 3940-83 | Yes | Not Seen |
| Pe AR 2617/77 | Yes | Not Seen |
| Pe AR 2612/77 | Yes | Not Seen |
| ArA 20086 | Yes | Yes |
| BeAR 517449 | Yes | Not Seen |

Phenotypic Characterization and Host Range.

Figures 9A, 9B, 9C:
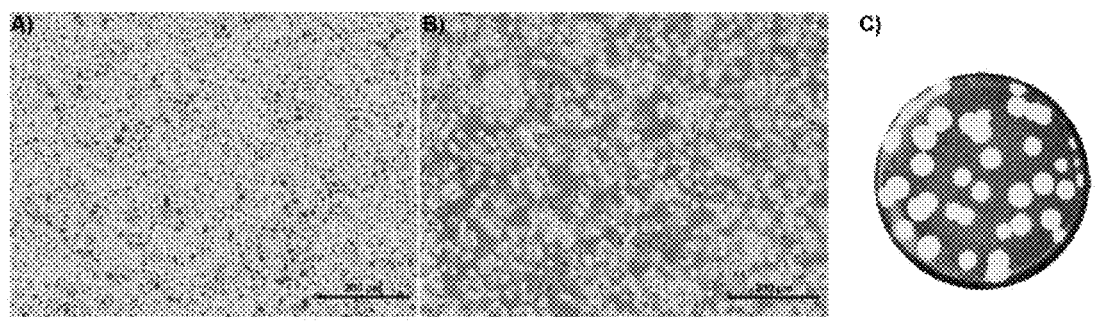
FIGS. 9A-9C. Cytopathic effects of Negev virus (E0329) infection in C7/10 cells. (A) Mock infected C7/10 monolayers observed with bright field microscopy at 12 hours post infection (hpi); (B) NEGV infected C7/10 cells with an MOI of 10 at 12 hpi observed under bright field microscopy; and (C) Representative plaques of Negev virus-infected C7/10 cells 36 hpi. Cells were fixed with 10% formalin and stained with crystal violet dye.

Negev virus strain E0239 infected and produced extensive CPE on C6/36 and C7/10 cells 12 hpi (FIGS. 9A and 9B); however, no overt cytopathic effects were observed in vertebrate cell lines at either 37° C. or 28° C. up to 6-days-post-infection (data not shown). Negev virus E0239 formed 3-4 mm size plaques on C7/10 cells at 36 hpi (FIG. 9C).

Figure 10A:
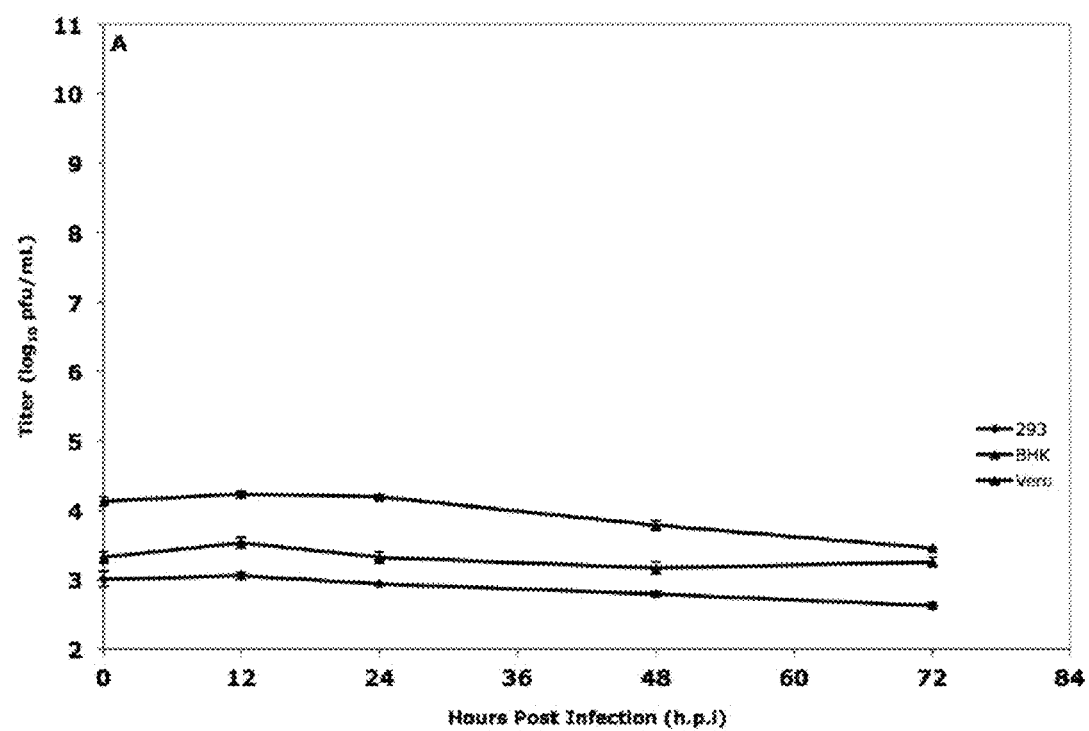
FIGS. 10A-10B. Comparative replication curves of prototype Negev virus (E0329) (A) Virus outputs from 12-72 hpi at a multiplicity of infection (MOI) of 10 by Negev E0329 in vertebrate cell lines Vero (African green monkey kidney), BHK-21 (baby hamster kidney) and HEK293 (human embryonic kidney). (B) Virus outputs from 12-72 hpi at MOI 10 by Negev virus in the following insect cell lines *Ae. albopictus* (C6/36 and C7/10), *An. albimanus*, *An. gambiae*, *Cx. tarsalis*, *P. papatasi*, and *D. melanogaster*. The limit of detection of the assay is 1.0 log 10 pfu/mL.
Figure 10B:
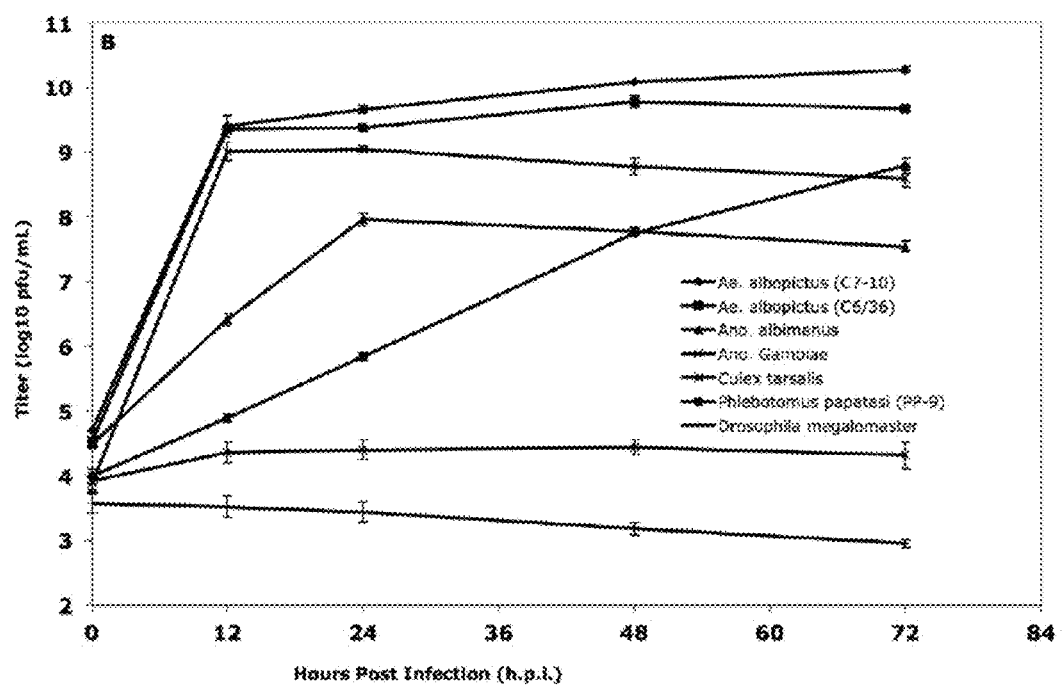

Representative vertebrate [African green monkey kidney (Vero), hamster kidney (BHK-21), and human embryonic kidney (HEK-293)] as well as invertebrate [*Ae. albopictus* (C6/36 and C7/10), *An. albimanus, An. gambiae, Cx. tarsalis, P. papatasi*, and *D. melanogaster*)] cell lines were used to determine the in vitro host range of Negev virus E0239. The cell-free supernatants of the infected cell lines were collected at 12, 24, 48, and 72 hpi and viral output was evaluated by plaque forming assay (pfu) on C7/10 cells. Negev virus E0239 failed to replicate in vertebrate cells at 37° C. (FIG. 10A) or 28° C. (data not shown), as mean replication titers remained steady or declined. However, these cell lines are permissive for replication with a wide range of arthropod-transmitted viruses (Karabatsos, 1985. International catalogue of arboviruses, including certain other viruses of vertebrates, 3rd ed. *American Society of Tropical Medicine and Hygiene*, San Antonio, Tex.). Mean replication titers of Negev virus showed significant differences in levels of replication in invertebrate cell lines (FIG. 10B). Mean replication titers peaked consistently at 24 hpi (FIG. 10B) and plateaued thereafter in all cell lines, except in *P. papatasi* where maximum titers were reached at 48 hpi and *An. gambiae* and *D. melanogaster* cells where mean replication titers remained steady or declined (FIG. 9B). Cell lysis was readily evident in *Aedes* (see FIG. 9B, depicting cytopathic effect (CPE) in C7/10 cells) and *Culex* (data not shown) cell lines at 12 hpi, whereas no overt CPE was observed in *An. albimanus* or *P. papatasi* cells at any time point (data not shown). The other 9 viruses included in this study demonstrated a similar phenotype, namely rapid growth and CPE in C6/36 cells, but no CPE in Vero or BHK-21 cells. Likewise, none of the viruses produced illness in newborn mice after intracerebral inoculation.

Mosquito Susceptibility Studies.

The inventors also investigated whether the prototype Negev virus E0329, could infect and disseminate after ingestion in two important mosquito vectors, *Ae. aegypti* and *Ae. albopictus*. As shown in Table 3, when *Ae. aegypti* ingested various concentrations of Negev virus, the level of infection varied in a dose dependent manner. At the highest dose of $10^9$ pfu/mL, 91% of midguts were infected, decreasing to 57% and 8%, for the $10^7$ and $10^5$ pfu/mL doses, respectively. Table 3 also shows that the percentage of mosquitoes with virus dissemination (total number of disseminated infections divided by total engorged mosquitoes) also decreased from 73% to 50% for the higher doses, to 0% for the lowest dose. Furthermore, dissemination rates from the infected midguts (total number of disseminated infections divided by total number of infected mosquitoes), ranged from 80% to 87.5% for the highest two doses, to 0% for the lowest dose. In contrast to *Ae. aegypti*, *Ae. albopictus* mosquitoes were relatively refractory to oral infection with Negev virus midgut and disseminated infection rates in the 5-6% range for all doses (Table 3). No mortality other than regularly observed attrition was observed in any of the mosquitoes during the 14-day incubation. Thus, infection with Negev virus did not appear to have a deleterious effect on the insects.

TABLE 3

| Species | Dose (pfu) | % infected | % disseminated |
| --- | --- | --- | --- |
| *Aedes aegypti* | $10^9$ | 91 (20/22) | 73 (16/22) |
|  | $10^7$ | 57 (8/14) | 50 (7/14) |
|  | $10^5$ | 8 (2/25) | 0 (0/25) |
| *Aedes albopictus* | $10^9$ | 5 (1/20) | 5 (1/20) |
|  | $10^7$ | 6 (2/35) | 6 (2/35) |

In addition to their broad geographic distribution, the Negeviruses appear to infect a wide range of hematophagous insects (mosquitoes of the genera *Culex, Aedes*, and *Anopheles* as well as sand flies of the genus *Lutzomyia*). The three isolates of Negev and of Loreto viruses were each made from pools of 3 different insect genera and/or species from two different localities. This suggests that these viruses are not species-specific and may have a broad host range among *Diptera*. All of the viruses described herein were obtained from hematophagous insects collected during arbovirus surveillance studies.

Recombinant Negevirus can be produced (1) entirely using cDNAs or RNAs or (2) a combination of cDNAs transfected into a host cell, or (3) cDNAs or RNAs transfected into a cell, which is further infected with an expression vector providing in trans supplemental components or activities needed to produce either an infectious or non-infectious (e.g., virus-like particle) recombinant Negevirus. In certain embodiments, RNA can also be used to produce a Negevirus. Using any of these methods, the minimum components required are an RNA molecule containing the cis-acting signals for (1) encapsidation of the genomic RNA by the Negevirus or other structural protein(s), and (2) replication of the genomic RNA.

For any gene or heterologous nucleic acid contained within the engineered Negevirus genome, the gene would be flanked by the appropriate transcription initiation and termination signals that will allow expression of those genes and production of protein products. Particularly a heterologous nucleic acid, which is a nucleic acid that is typically not encoded by a Negevirus as isolated from nature or contains a Negevirus coding region in a position, form, or context that it typically is not found, e.g., a chimeric protein. In certain aspects a heterologous nucleic acid can encode an insecticidal protein or nucleic acid.

To produce "non-infectious" engineered Negevirus, the engineered Negevirus must have the minimal replicon elements. This produces virus particles that are budded from the cell, but are non-infectious particles. To produce "infectious" particles, the virus particles must additionally comprise proteins that can mediate virus particle binding and fusion, such as through the use of an attachment protein or receptor ligand, and proteins for encapsidation of the genome.

In certain aspects, the first step in generating a recombinant Negevirus is expression of an RNA that is a genomic equivalent from an expression vector, e.g., a cDNA. The RNA is packaged in a virus, which can be recovered. If any Negevirus protein is absent from the recombinant RNA genome, then it is typically supplied in trans.

For preparing "non-infectious Negevirus" particles, the procedure may be the same as above, except that the expression vector transfected into the cells would contain some but not all Negevirus genes. The expression vector of non-infectious Negevirus particles may additionally contain a gene encoding a reporter protein or a therapeutic/heterologous nucleic acid, e.g., an insecticidal nucleic acid.

Transfected cells are usually incubated for at least 24 hr at a desired temperature, usually about 37° C. For non-infectious virus particles, the supernatant is collected and the virus particles isolated. For infectious virus particles, the supernatant containing virus is harvested and transferred to fresh cells. The fresh cells are incubated for approximately 48 hours, and the supernatant is collected.

The virus or virus-like particle can then be isolated and/or purified. The terms "isolation" or "isolating" a Negevirus means the process of culturing and purifying the virus particles such that very little cellular debris remains. One example would be to take the virion containing supernatant and pass them through a 0.1-0.2 micron pore size filter (e.g., Millex-GS, Millipore) to remove the virus and cellular debris. Alternatively, virions can be purified using a gradient, such as a sucrose gradient. Recombinant Negevirus particles can then be pelleted and suspended in whatever excipient or carrier is desired. Titers can be determined by indirect immunofluorescence using antibodies specific for particular proteins.

A "suitable cell" or "host cell" means any cell that would permit assembly of the recombinant Negevirus. Methods for identifying such a cell are described herein. The terms "cell," "cell line," and "cell culture" may be used interchangeably. All of these terms also include their progeny, which is any and all subsequent generations. It is understood that all progeny may not be identical due to deliberate or inadvertent mutations. In the context of expressing a heterologous nucleic acid sequence, "host cell" refers to a prokaryotic or eukaryotic cell, and it includes any transformable organism that is capable of replicating a vector and/or expressing a heterologous gene encoded by a vector. A host cell can, and has been, used as a recipient for vectors or viruses. A host cell may be "transfected" or "transformed," which refers to a process by which exogenous nucleic acid, such as a modified protein-encoding sequence, is transferred or introduced into the host cell. A transformed cell includes the primary subject cell and its progeny.

Host cells may be derived from prokaryotes or eukaryotes, including yeast cells, insect cells, and mammalian cells, depending upon whether the desired result is replication of the vector or expression of part or all of the vector-encoded nucleic acid sequences. Numerous cell lines and cultures are available for use as a host cell, and they can be obtained through the American Type Culture Collection (ATCC), which is an organization that serves as an archive for living cultures and genetic materials (www.atcc.org). An appropriate host can be determined by one of skill in the art based on the vector backbone and the desired result. A plasmid or cosmid, for example, can be introduced into a prokaryote host cell for replication of many vectors. Many host cells from various cell types and organisms are available and would be known to one of skill in the art. Similarly, a viral vector may be used in conjunction with either a eukaryotic or prokaryotic host cell, particularly one that is permissive for replication or expression of the vector.

Host and host cells include but are not limited to mosquitoes and sandflies. The term "mosquito" as used herein concerns any type of mosquito (e.g., *Anopheles, Aedes*, and *Culex*), including but not limited to members of the group Anophelinae (*Anopheles, Bironella*, and *Chagasia*) and Culicinae (*Aedeomyia, Aedes, Armigeres, Ayurakitia, Borachinda, Coquillettidia, Culex, Culiseta, Deinocerites, Eretmapodites, Ficalbia, Galindomyia, Haemagogus, Heizmannia, Hodgesia, Isostomyia, Johnbelkinia, Kimia, Limatus, Lutzia, Malaya, Mansonia, Maorigoeldia, Mimomyia, Onirion, Opifex, Orthopodomyia, Psorophora, Runchomyia, Sabethes, Shannoniana, Topomyia, Toxorhynchites, Trichoprosopon, Tripteroides, Udaya, Uranotaenia, Verrallina*), as well as cells thereof. In certain aspects the host or host cell is Tiger mosquitoes, *Aedes albopictus* (e.g., C6/36 and C7/10 cells), AP-61 line of *Aedes pseudoscutellaris* (AP-61 cells), *Aedes aegypti, Aedes aboriginis, Aedes cantator, Aedes sierrensis, Aedes sollicitans, Aedes squamiger, Aedes sticticus, Aedes vexans, Culex coronator, Culex pipiens, Culex quinquefaxciatus, Culex vishnui, Culex tarsalis, Anopheles coustani, Anopheles albimanus, Anopheles gambiae*, and *Anopheles quadrimaculatus.*

Sandfly is a colloquial name for any species or genus of flying, biting, blood-sucking Dipteran encountered in sandy areas. Sandflies belong to the fly family Psychodidae. Sandflies include, but are not limited to members of the *Brumptomyia, Lutzomyia, Warileya, Phlebotomus, Sergentomyia*, or *Sauroleishmania* genus or cell derived therefrom. In certain aspects *Phlebotomus papatasi* cells are used as a host cell.

II. Negevirus Nucleic Acids

The present invention includes polynucleotides isolatable from cells or viruses that are capable of expressing all or part of a Negevirus, Negevirus nucleic acid, and/or a Negevirus protein or polypeptide. Some embodiments concern all or parts of a viral genome that has been specifically mutated or altered to generate a virus or viral polypeptide. The polynucleotides may encode a peptide or polypeptide containing all or part of a viral and/or heterologous amino acid sequence, e.g., a therapeutic or insecticidal polypeptide. Recombinant proteins can be purified from cells expressing nucleic acids described herein.

As used herein, the term "RNA, DNA, or nucleic acid segment" refers to a RNA, DNA, or nucleic acid molecule that has been isolated from host cell RNA or DNA or other contaminants. Included within the term "nucleic acid" are polynucleotides and recombinant vectors, including, for example, plasmids, viruses, and the like.

As used in this application, the term "Negevirus polynucleotide" refers to any member of the Negevirus group as defined herein. The term "Negev virus" refers to a particular subset (e.g., species or variant) of Negevirus. Other members Negevirus include Piura virus, Loreto virus, Dezidougou virus, Santana virus, and Ngewotan virus.

The term "cDNA" is intended to refer to DNA prepared using RNA as a template. There may be times when the full or partial viral genome is prepared as a cDNA. As will be understood by those in the art, the term nucleic acid includes genomic sequences, cDNA sequences, and smaller engineered nucleic acid segments that express, or may be adapted to express, proteins, polypeptides, domains, peptides, fusion proteins, and variants. A nucleic acid encoding all or part of a native or modified polypeptide may contain a contiguous nucleic acid of: 10, 20, 30, 40, 50, 60, 70, 80, 90, 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, 400, 410, 420, 430, 440, 441, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800, 810, 820, 830, 840, 850, 860, 870, 880, 890, 900, 910, 920, 930, 940, 950, 960, 970, 980, 990, 1000, 1010, 1020, 1030, 1040, 1050, 1060, 1070, 1080, 1090, 1095, 1100, 1500, 2000, 2500, 3000, 3500, 4000, 4500, 5000, 5500, 6000, 6500, 7000, 7500, 8000, 9000, 10000, or more nucleotides, nucleosides, or base pairs corresponding to SEQ ID NO:3, 6, 7, 8, 11, 14, 15, 16, or 19.

The nucleic acid segments used in the present invention, regardless of the length of the coding sequence, may be combined with other nucleic acid sequences, such as promoters, polyadenylation signals, additional restriction enzyme sites, multiple cloning sites, other coding segments, and the like, such that their overall length may vary considerably. It is therefore contemplated that a nucleic acid fragment of almost any length may be employed, with the total length preferably being limited by the ease of preparation and use in the intended recombinant nucleic acid protocol.

A nucleic acid sequence may encode a full-length polypeptide sequence with additional heterologous coding sequences, for example, to allow for purification of the polypeptide, transport, secretion, and/or post-translational modification. A tag or other heterologous polypeptide may be added to a polypeptide-encoding sequence, wherein "heterologous" refers to a polynucleotide or encoded polypeptide or segment thereof that is not typically found associated with or encoded by the naturally occurring virus.

In a non-limiting example, one or more nucleic acid construct may be prepared that include a contiguous stretch of nucleotides identical to or complementary to a particular Negevirus viral segment, such as a Negevirus ORF1, ORF2, and/or ORF3. A nucleic acid construct may be at least 20, 30, 40, 50, 60, 70, 80, 90, 100, 110, 120, 130, 140, 150, 160, 170, 180, 190, 200, 250, 300, 400, 500, 600, 700, 800, 900, 1000, 2000, 3000, 4000, 5000, 6000, 7000, 8000, 9000, 10000, 15000, or 20000 nucleotides in length (including all intermediate lengths and intermediate ranges). It will be readily understood that "intermediate lengths" and "intermediate ranges," as used herein, means any length or range including or between the quoted values (i.e., all integers including and between such values).

The nucleic acid segments used in the present invention encompass nucleic acids that are 70, 75, 80, 85, 90, 91, 92, 93, 94, 95, 96, 97, 98, 99, or 100% identical (including all values and ranges there between) to SEQ ID NO:2, 3, 6, 7, 8, 11, 14, 15, 16, or 19. Such sequences may arise as a consequence of codon redundancy and functional equivalency that are known to occur naturally within nucleic acid sequences and the proteins thus encoded. Alternatively, functionally equivalent proteins or peptides may be created via the application of recombinant DNA technology, in which changes in the protein structure may be engineered, based on considerations of the properties of the amino acids being exchanged. Changes designed by human may be introduced through the application of site-directed mutagenesis techniques, e.g., to introduce improvements to the antigenicity of a protein, to modulate toxic effects, or to increase the efficacy of any treatment involving the protein or a virus comprising such protein.

It also will be understood that this invention is not limited to the particular nucleic acid and amino acid sequences of these identified sequences. Recombinant vectors and isolated nucleic acid segments may therefore variously include Negevirus-coding regions themselves, coding regions bearing selected alterations or modifications in the basic coding region, or they may encode larger polypeptides that nevertheless include Negevirus-coding regions, or may encode biologically functional equivalent proteins or peptides that have variant amino acids sequences.

A. Mutagenesis of Negevirus Polynucleotides

In various embodiments, the Negevirus polynucleotide may be altered or mutagenized. Alterations or mutations may include insertions, deletions, point mutations, inversions, and the like and may result in the modulation, activation and/or inactivation of certain proteins or molecular mechanisms, as well as altering the function, location, or expression of a gene product, in particular rendering a gene product non-functional. Where employed, mutagenesis of a polynucleotide encoding all or part of a Negevirus may be accomplished by a variety of standard, mutagenic procedures (Sambrook et al., 2001). Mutation is the process whereby changes occur in the quantity or structure of an organism. Mutation can involve modification of the nucleotide sequence of a single gene, blocks of genes or whole genomes. Changes in single genes may be the consequence of point mutations which involve the removal, addition or substitution of a single nucleotide base within a DNA sequence, or they may be the consequence of changes involving the insertion or deletion of large numbers of nucleotides.

Insertional mutagenesis is based on the inactivation of a gene via insertion of a known nucleic acid fragment. Because it involves the insertion of some type of nucleic acid fragment, the mutations generated are generally loss-of-function, rather than gain-of-function mutations. However, there are several examples of insertions generating gain-of-function mutations. Insertional mutagenesis may be accomplished using standard molecular biology techniques.

Chemical mutagenesis offers certain advantages, such as the ability to find a full range of mutations with degrees of phenotypic severity, and is facile and inexpensive to perform.

Radiation mutagenesis is the result of biological molecules being degraded by ionizing radiation. Ionizing radiation causes DNA damage, generally proportional to the dose rate.

Random mutagenesis may be introduced using error prone PCR. The rate of mutagenesis may be increased by performing PCR in multiple tubes with dilutions of templates. One particularly useful mutagenesis technique is alanine scanning mutagenesis in which a number of residues are substituted individually with the amino acid alanine so that the effects of losing side-chain interactions can be determined, while minimizing the risk of large-scale perturbations in protein conformation.

In vitro scanning saturation mutagenesis provides a rapid method for obtaining a large amount of structure-function information including: (i) identification of residues that modulate ligand binding specificity, (ii) a better understanding of ligand binding based on the identification of those amino acids that retain activity and those that abolish activity at a given location, (iii) an evaluation of the overall plasticity of an active site or protein subdomain, (iv) identification of amino acid substitutions that result in increased binding.

Polynucleotide may also be modified using site-directed mutagenesis. Structure-guided site-specific mutagenesis represents a powerful tool for the dissection and engineering of protein-ligand interactions (Wells, 1996; Braisted et al., 1996). The technique provides for the preparation and testing of sequence variants by introducing one or more nucleotide sequence changes into a selected DNA.

B. Vectors

A Negevirus genome, or segment thereof, can be encoded by a nucleic acid vector. The term "vector" is used to refer to a carrier nucleic acid molecule into which an exogenous nucleic acid sequence can be inserted for introduction into a cell where it can be replicated. Vectors include plasmids, cosmids, viruses (bacteriophage, animal viruses, and plant viruses), and artificial chromosomes (e.g., YACs).

A vector can encode modified or non-modified polypeptide sequences comprising heterologous sequences such as a tag or targeting molecule. Useful vectors encoding such fusion proteins include pIN vectors, vectors encoding a stretch of histidines; and pGEX vectors, for use in generating glutathione S-transferase (GST) soluble fusion proteins for later purification and separation or cleavage. A targeting molecule is one that directs the modified polypeptide to a particular organ, tissue, cell, or other location in a subject's body. Alternatively, the targeting molecule alters the tropism of an organism, such as Negevirus for certain cell types.

The term "expression vector" refers to a vector containing a nucleic acid sequence coding for at least part of a gene product capable of being transcribed. In some cases, RNA molecules are translated into a protein, polypeptide, or peptide. In other cases, these sequences are not translated, for example, in the production of antisense molecules or ribozymes. Expression vectors can contain a variety of "control sequences," which refer to nucleic acid sequences necessary for the transcription and possibly translation of an operably linked coding sequence in a particular host organism. In addition to control sequences that govern transcription and translation, vectors and expression vectors may contain nucleic acid sequences that serve other functions as well.

An expression vector typically includes a promoter and/or enhancer. A "promoter" is a control sequence that is a region of a nucleic acid sequence at which initiation and rate of transcription are controlled. It may contain genetic elements that bind regulatory proteins and molecules, such as RNA polymerase and other transcription factors. The phrases "operatively positioned," "operatively coupled," "operatively linked," "under control," and "under transcriptional control" mean that a promoter is in a correct functional location and/or orientation in relation to a nucleic acid sequence to control transcriptional initiation and/or expression of that sequence. A promoter may or may not be used in conjunction with an "enhancer," which refers to a cis-acting regulatory sequence involved in the transcriptional activation of a nucleic acid sequence.

Other elements that can be included in an expression vector are initiation signals and internal ribosome binding sites. A specific initiation signal also may be required for efficient translation of coding sequences. These signals include the ATG initiation codon or adjacent sequences. Exogenous translational control signals, including the ATG initiation codon, may need to be provided. An exogenous translational control signals and initiation codons can be either natural or synthetic. In certain embodiments of the invention, the use of internal ribosome entry sites (IRES) elements are used to create multigene, or polycistronic, messages. IRES elements are able to bypass the ribosome-scanning model of 5' methylated Cap dependent translation and begin translation at internal sites. In certain aspects, the 5' UTR can be used as an IRES element.

The vectors or constructs of the present invention will generally comprise at least one termination signal. A "termination signal" or "terminator" is comprised of the RNA sequences involved in specific termination of an RNA transcript by an RNA polymerase. Thus, in certain embodiments a termination signal that ends the production of an RNA transcript is contemplated. A terminator may be necessary in vivo to achieve desirable message levels.

In expression, particularly eukaryotic expression, one will typically include a polyadenylation signal to effect proper polyadenylation of the transcript. The nature of the polyadenylation signal is not believed to be crucial to the successful practice of the invention, and/or any such sequence may be employed. Preferred embodiments include the SV40 polyadenylation signal and/or the bovine growth hormone polyadenylation signal, convenient and/or known to function well in various target cells. Polyadenylation may increase the stability of the transcript or may facilitate cytoplasmic transport.

In order to propagate a vector in a host cell, it may contain one or more origins of replication sites (often termed "ori"), which is a specific nucleic acid sequence at which replication is initiated. Alternatively an autonomously replicating sequence (ARS) can be employed if the host cell is yeast.

In certain embodiments of the invention, cells containing a nucleic acid construct of the present invention may be identified in vitro or in vivo by including a marker in the expression vector. Such markers would confer an identifiable change to the cell permitting easy identification of cells containing the expression vector. Generally, a selectable marker is one that confers a property that allows for selection. A positive selectable marker is one in which the presence of the marker allows for its selection, while a negative selectable marker is one in which its presence prevents its selection. An example of a positive selectable marker is a drug resistance marker.

Usually the inclusion of a drug selection marker aids in the cloning and identification of transformants, for example, genes that confer resistance to neomycin, puromycin, hygromycin, DHFR, GPT, zeocin and histidinol arc useful selectable markers. In addition to markers conferring a phenotype that allows for the discrimination of transformants based on the implementation of conditions, other types of markers including screenable markers such as GFP, whose basis is colorimetric analysis, are also contemplated. Alternatively, screenable enzymes such as herpes simplex virus thymidine kinase (tk) or chloramphenicol acetyltransferase (CAT) may be utilized. One of skill in the art would also know how to employ immunologic markers, possibly in conjunction with FACS analysis. The marker used is not believed to be important, so long as it is capable of being expressed simultaneously with the nucleic acid encoding a gene product. Further examples of selectable and screenable markers are well known to one of skill in the art.

C. Insecticidal Peptides and Polypeptides

In certain aspects a heterologous nucleic acid is toxic or encodes an insecticidal polypeptide/peptide. Insecticidal peptides include toxins such as the omega-ACTX-1 family of insecticidal toxins (e.g., omega-ACTX-Hv1a), *Bacillus thuringiensis* toxins, neurotoxins, juvenile hormone esterases and variants thereof. In certain aspects the heterologous nucleic acid can encode a polypeptide that disrupts insect propagation, e.g., oostatic peptides such as trypsin modulating oostatic factor (TMOF) and neuropeptide F (NPF)) and variants thereof. Various examples of suitable Insecticidal peptides are discussed in greater detail below.

Juvenile Hormone Esterases.

The term "juvenile hormone esters" as used herein includes mutants or analogs of the naturally occurring proteins. Several useful JHE mutants are described in PCT Application WO 94/03588 published Feb. 17, 1994. Juvenile hormone esters (JHE) are insect proteins, which appears at critical times in the insect's life. It appears to present no risk to other groups of organisms. It is nonlethal to an individual cell, which allows and perhaps encourages viral replication; yet the enzyme will fatally disrupt the normal development of the organism. U.S. Pat. No. 5,098,706 provides an example of the administration of an affinity purified JHE enzyme to insects, which results in anti juvenile hormone activity. Such anti-juvenile hormone activity is effectively lethal.

Bacillus thuringiensis Insecticidal Peptides.

Insecticidal peptides or toxins obtained from any of a variety of *Bacillus thuringiensis* strains can be used in certain aspects. These toxins are well known. For example, U.S. Pat. Nos. 4,448,885 and 4,467,036 describe the expression of *Bacillus thuringiensis* crystal protein in *Escherichia coli*.

Insect Toxins.

Numerous insect toxins may be used to carry out the present invention, some of which are described in U.S. Pat. No. 6,162,430. For example, the insect toxin may be a neurotoxin derived from or similar to an arthropod or other invertebrate toxin, such as a scorpion toxin, a wasp toxin, a snail toxin, a mite toxin, or a spider toxin. A useful scorpion toxin is, for example, AaIT from *Androctonus australis*. A useful snail venom is that from the snail *Conus querciones* (Olivera et al., (1990) *Science*, 249:257-263).

Yet another suitable toxin affects insect sodium channels in a manner very similar to the effect of α-toxins on mammalian sodium channels. This neurotoxin was derived from a yellow scorpion *Leuirus quinquestriatus hebraeus*, LqhoαIT and LqhIT2 (Eitan et al., (1990) *Biochemistry*, 29:5941-5947).

TMOF and TMOF Analogs.

Serine esterases such as trypsin and trypsin-like enzymes (collectively referred to herein as "TTLE") are important components of the digestion of proteins by insects. In the mosquito, *Aedes aegypti*, an early trypsin that is found in the midgut of newly emerged females is replaced, following the blood meal, by a late trypsin. A female mosquito typically weighs about 2 mg and produces 4 to 6 μg of trypsin within several hours after ingesting a blood meal. Continuous biosynthesis at this rate would exhaust the available metabolic energy of a female mosquito; as a result, the mosquito would be unable to produce mature eggs, or even to find an oviposition site. To conserve metabolic energy, the mosquito regulates TTLE biosynthesis with a peptide hormone named Trypsin Modulating Oostatic Factor (TMOF). Mosquitoes produce TMOF in the follicular epithelium of the ovary 12-35 hours after a blood meal; TMOF is then released into the hemolymph where it binds to a specific receptor on the midgut epithelial cells, signaling the termination of TTLE biosynthesis. This regulatory mechanism is not unique for mosquitoes; flesh flies, fleas, sand flies, house flies, dog flies and other insect pests which need protein as part of their diet have similar regulatory mechanisms. PCT Patent Application WO 00/63233, published Oct. 26, 2000, discloses examples of TMOF analogs.

D. Immunogenic Peptides and Polypeptides

Certain embodiments are directed to recombinant Negevirus compositions that can induce an immune response when administered to a subject. An immunogenic composition can comprise a replication-competent, attenuated, recombinant Negevirus or a vector encoding the same. In certain embodiments, the immunogenic composition contains a recombinant Negevirus described herein. Certain aspects are directed to a recombinant Negev virus as described herein. In a further aspect a recombinant Negevirus comprises a heterologous nucleic acid encoding one or more antigens that stimulate an immune response when administered to a subject. In certain embodiments a heterologous nucleic acid encodes a heterologous antigen. As used herein, the term "antigen" or "targeted antigen" refers to a substance that is capable of being the target of an immune response. An antigen may be the target of, for example, a cell-mediated and/or humoral immune response of a subject administered or provided an immunogenic composition described herein. The term "antigen" or "targeted antigen" encompasses includes, but is not limited to all or part of viral antigens, tumor-specific or -related antigens, bacterial antigens, parasitic antigens, allergens, and the like.

E. Nucleic Acid Detection

In addition to their use in directing the expression of Negevirus proteins, polypeptides and/or peptides, the nucleic acid sequences disclosed herein have a variety of other uses. For example, they have utility as probes or primers for embodiments involving nucleic acid hybridization or amplification. They may be used in diagnostic or screening methods. Detection of nucleic acids encoding Negevirus or Negevirus polypeptides are encompassed by the invention.

The use of a probe or primer of between 13 and 100 nucleotides, preferably between 17 and 100 nucleotides in length, or in some aspects of the invention up to 1-2 kilobases or more in length, allows the formation of a duplex molecule that is both stable and selective. Molecules having complementary sequences over contiguous stretches greater than 20 bases in length are generally preferred, to increase stability and/or selectivity of the hybrid molecules obtained. One will generally prefer to design nucleic acid molecules for hybridization having one or more complementary sequences of 20 to 30 nucleotides, or even longer where desired. Such fragments may be readily prepared, for example, by directly synthesizing the fragment by chemical means or by introducing selected sequences into recombinant vectors for recombinant production.

Accordingly, the nucleotide sequences of the invention may be used for their ability to selectively form duplex molecules with complementary stretches of DNAs and/or RNAs or to provide primers for amplification of DNA or RNA from samples. Depending on the application envisioned, one would desire to employ varying conditions of hybridization to achieve varying degrees of selectivity of the probe or primers for the target sequence.

In certain embodiments, it will be advantageous to employ nucleic acids of defined sequences of the present invention in combination with an appropriate means, such as a label, for determining hybridization. A wide variety of appropriate indicator means are known in the art, including fluorescent, radioactive, enzymatic or other ligands, such as avidin/biotin, which are capable of being detected. In certain embodiments, one may desire to employ a fluorescent label or an enzyme tag such as urease, alkaline phosphatase or peroxidase, instead of radioactive or other environmentally undesirable reagents. In the case of enzyme tags, colorimetric indicator substrates are known that can be employed to provide a detection means that is visibly or spectrophotometrically detectable, to identify specific hybridization with complementary nucleic acid containing samples.

The term "primer," as used herein, is meant to encompass any nucleic acid that is capable of priming the synthesis of a nascent nucleic acid in a template-dependent process. Typically, primers are oligonucleotides from ten to twenty and/or thirty base pairs in length, but longer sequences can be employed. Primers may be provided in double-stranded and/or single-stranded form, although the single-stranded form is preferred.

A number of template dependent processes are available to amplify the oligonucleotide sequences present in a given template sample. One of the best-known amplification methods is the polymerase chain reaction (referred to as PCR™), which is described in detail in U.S. Pat. Nos. 4,683,195, 4,683,202 and 4,800,159, each of which is incorporated herein by reference in their entirety.

Nucleic acids can be visualized using a variety of methods, including staining of a gel with ethidium bromide and visualization of bands under UV light. Alternatively, if the amplification products are integrally labeled with radio- or fluorometrically-labeled nucleotides, the separated amplification products can be exposed to x-ray film or visualized under the appropriate excitatory spectra.

In particular embodiments, detection is by Southern blotting and hybridization with a labeled probe. The techniques involved in Southern blotting are well known to those of skill in the art. One example of the foregoing is described in U.S. Pat. No. 5,279,721, incorporated by reference herein, which discloses an apparatus and method for the automated electrophoresis and transfer of nucleic acids. Other methods of nucleic acid detection that may be used in the practice of the instant invention are disclosed in U.S. Pat. Nos. 5,840,873, 5,843,640, 5,843,651, 5,846,708, 5,846,717, 5,846,726, 5,846,729, 5,849,487, 5,853,990, 5,853,992, 5,853,993, 5,856,092, 5,861,244, 5,863,732, 5,863,753, 5,866,331, 5,905,024, 5,910,407, 5,912,124, 5,912,145, 5,919,630, 5,925,517, 5,928,862, 5,928,869, 5,929,227, 5,932,413 and 5,935,791, each of which is incorporated herein by reference.

III. Negevirus Polypeptides

Certain embodiments are directed to Negevirus polypeptides. Negevirus polypeptides include the encoded polyproteins and polypeptides as well as segments thereof. Negevirus polypeptides include those having the amino acid sequences set forth in SEQ ID NO:5, 10, 13, 18, or 21. In certain aspects, a Negevirus polypeptide is a variant of one or more of the polypeptides corresponding to SEQ ID NO:5, 10, 13, 18, or 21. In certain aspects of the invention these viral polypeptides and/or variants thereof can be comprised in a proteinaceous composition. Proteinaceous compositions include viral particles, virus-like particles, immunostimulatory compositions, and other compositions having one or more viral polypeptide components. Polypeptide variant(s) can be engineered or selected for a modification in one or more physiological or biological characteristics, such as host cell range, host cell specificity, toxicity to non-target cells or organs, replication, cytotoxicity to a target cell, infectivity, manufacturing parameters, size of virus particle, stability of viral particles, in vivo clearance, immunoreactivity, and the like. These polypeptide variants can be engineered by using a variety of methodologies know in the art, including various mutagenesis techniques described see below.

When the present application refers to the function or activity of viral proteins or polypeptides, it is meant to refer to the activity or function of that viral protein or polypeptide under physiological conditions, unless otherwise specified. Determination of which molecules possess certain activity may be achieved using assays familiar to those of skill in the art, such as infectivity assays, protein binding assays, plaque assays and the like.

As used herein, a "protein" or "polypeptide" refers to a molecule comprising polymer of amino acid residues. In some embodiments, a wild-type version of a protein or polypeptide are employed, however, in many embodiments of the invention, all or part of a viral protein or polypeptide is absent or altered so as to render the virus more suitable for a particular use. The terms described above may be used interchangeably herein.

A "modified protein" or "modified polypeptide" or "variant protein" or "variant polypeptide" refers to a protein or polypeptide whose chemical structure or amino acid sequence is altered with respect to the wild-type or a reference protein or polypeptide. In some embodiments, a modified protein or polypeptide has at least one modified activity or function (recognizing that proteins or polypeptides may have multiple activities or functions). The modified activity or function may be reduced, diminished, eliminated, enhanced, improved, or altered in some other way (such as infection specificity) with respect to that activity or function in a wild-type protein or polypeptide, or the characteristics of virus containing such a polypeptide. It is contemplated that a modified protein or polypeptide may be altered with respect to one activity or function yet retain unaltered activity or function in other respects. Alternatively, a modified protein may be completely nonfunctional or its cognate nucleic acid sequence may have been altered so that the polypeptide is no longer expressed at all, is truncated, or expresses a different amino acid sequence as a result of a frameshift, fusion, or other modification.

In certain embodiments the size of a recombinant protein or polypeptide may comprise, but is not limited to, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 110, 120, 130, 140, 150, 160, 170, 180, 190, 200, 210, 220, 230, 240, 250, 275, 300, 325, 350, 375, 400, 425, 450, 475, 500, 525, 550, 575, 600, 625, 650, 675, 700, 725, 750, 775, 800, 825, 850, 875, 900, 925, 950, 975, 1000, 1100, 1200, 1300, 1400, 1500, 1750, 2000, 2250, 2500 or greater amino molecule residues, and any range derivable therein, of a polypeptide corresponding to SEQ ID NO:5, 10, 13, 18, or 21. It is contemplated that polypeptides may be modified by truncation, rendering them shorter than their corresponding unaltered form or by fusion or domain shuffling which may render the altered protein longer.

The term "proteinaceous composition" encompasses amino molecule sequences comprising at least one of the 20 common amino acids in naturally synthesized proteins, or at least one modified or unusual amino acid. Proteinaceous compositions may be made by any technique known to those of skill in the art, including the expression of proteins, polypeptides, or peptides through standard molecular biological techniques, or the chemical synthesis of proteinaceous materials.

Amino acid sequence variants of the polypeptides of the present invention can be substitutional, insertional or deletion variants. A mutation in a gene encoding a viral polypeptide may affect 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 110, 120, 130, 140, 150, 160, 170, 180, 190, 200, 210, 220, 230, 240, 250, 275, 300, 325, 350, 375, 400, 425, 450, 475, 500 or more non-contiguous or contiguous amino acids (i.e., segment) of a polypeptide, as compared to a wild-type or unaltered polypeptide or other reference polypeptides. Various polypeptides encoded by Negeviruses may be identified by reference to and alignment with GenBank Accession Numbers and the related public database entries.

Deletion variants lack one or more residues of the native, unaltered, or wild-type protein SEQ ID NO:5, 10, 13, 18, or 21. Individual residues can be deleted, or all or part of a domain (such as a catalytic or binding domain) can be removed. A stop codon can be introduced (by substitution or insertion) into a nucleic acid sequence to generate a truncated protein.

An insertion mutation typically involves the addition of material at a non-terminal position in a polypeptide. A chimeric polypeptide is a particular type of insertion mutant that include homologous or similar portions of a related protein in place of the related portion of a target protein. This may include the insertion of an immunoreactive epitope or simply one or more residues. Terminal additions, typically called fusion proteins, may also be generated.

Substitution variants typically contain the exchange of one amino acid for another at one or more sites within the protein, and may be designed to modulate one or more properties of the polypeptide, with or without the loss of other functions or properties. Substitutions may be conservative, that is, one amino acid is replaced with one of similar shape and charge. Conservative substitutions are well known in the art and include, for example, the changes of: alanine to serine; arginine to lysine; asparagine to glutamine or histidine; aspartate to glutamate; cysteine to serine; glutamine to asparagine; glutamate to aspartate; glycine to proline; histidine to asparagine or glutamine; isoleucine to leucine or valine; leucine to valine or isoleucine; lysine to arginine; methionine to leucine or isoleucine; phenylalanine to tyrosine, leucine or methionine; serine to threonine; threonine to serine; tryptophan to tyrosine; tyrosine to tryptophan or phenylalanine; and valine to isoleucine or leucine. Alternatively, substitutions may be non-conservative such that a function or activity of the polypeptide is affected. Non-conservative changes typically involve substituting a residue with one that is chemically dissimilar, such as a polar or charged amino acid for a nonpolar or uncharged amino acid, and vice versa.

The term "functionally equivalent codon" is used herein to refer to codons that encode the same amino acid, such as the six codons for arginine or serine, and also refers to codons that encode biologically equivalent amino acids (Amino Acids/Codons): Alanine (Ala)/GCA, GCC, GCG, or GCU; Cysteine (Cys)/UGC or UGU; Aspartic acid (Asp)/GAC or GAU; Glutamic acid (Glu)/GAA or GAG; Phenylalanine (Phe)/UUC or UUU; Glycine (Gly)/GGA, GGC, GGG, or GGU; Histidine (His)/CAC or CAU; Isoleucine (Ile)/AUA, AUC, or AUU; Lysine (Lys)/AAA or AAG; Leucine (Leu)/UUA, UUG, CUA, CUC, CUG, or CUU; Methionine (Met)/AUG; Asparagine (Asn)/AAC or AAU; Proline (Pro)/CCA, CCC, CCG, or CCU; Glutamine (Gln)/CAA or CAG; Arginine (Arg)/AGA, AGG, CGA, CGC, CGG, or CGU; Serine (Ser)/AGC, AGU, UCA, UCC, UCG, or UCU; Threonine (Thr)/ACA, ACC, ACG, or ACU; Valine (Val)/GUA, GUC, GUG, or GUU; Tryptophan (Trp)/UGG; and Tyrosine (Tyr)/UAC or UAU.

It also will be understood that amino acid and nucleic acid sequences may include additional residues, such as additional N- or C-terminal amino acids or 5' or 3' sequences, and yet still be essentially as set as forth herein, including having a certain biological activity.

The following is a discussion based upon changing of the amino acids of a Negevirus protein to create an equivalent, or even an improved, molecule. For example, certain amino acids may be substituted for other amino acids in a protein structure without appreciable loss of interactive binding capacity with structures such as, for example, antigen-binding regions of antibodies or binding sites on substrate molecules. Since it is the interactive capacity and nature of a protein that defines that protein's biological functional activity, certain amino acid substitutions can be made in a protein sequence, and in its underlying DNA coding sequence, and nevertheless produce a protein with like properties. It is thus contemplated by the inventors that various changes may be made in the nucleic acid sequences of Negeviruses without appreciable loss of biological utility or activity of interest, as discussed below.

In making such changes, the hydropathic index of amino acids may be considered. The importance of the hydropathic amino acid index in conferring a biologic function on a protein is generally understood in the art (Kyte and Doolittle, 1982). It is accepted that the relative hydropathic character of the amino acid contributes to the secondary structure of the resultant protein, which in turn defines the interaction of the protein with other molecules, for example, enzymes, substrates, receptors, DNA, antibodies, antigens, and the like.

IV. Antibodies

The isolated viruses can be used to produce or detect antibodies specific for one or more Negeviruses. Certain embodiments are directed to an isolated antibody that specifically binds a Negevirus polypeptide. In certain aspects the Negevirus specific antibody binds a segment of a polypeptide encoded by a Negevirus ORF1, ORF2, or ORF3. Again, any given antibody can recognize and bind one of a number of possible epitopes present in the polypeptide; thus only a unique portion of a polypeptide (having the epitope) needs to be present in an assay to determine if the antibody specifically binds the polypeptide.

By "an antibody that specifically binds" a Negevirus polypeptide or protein is meant an antibody that selectively binds to an epitope on any portion of the Negevirus peptide such that the antibody binds specifically to the corresponding Negevirus polypeptide without significant background. Specific binding by an antibody further means that the antibody can be used to selectively remove the target polypeptide from a sample comprising the polypeptide or and can readily be determined by radioimmunoassay (RIA), bioassay, or enzyme-linked immunosorbent (ELISA) technology. An ELISA method effective for the detection of the specific antibody-antigen binding can, for example, be as follows: (1) bind the antibody to a substrate; (2) contact the bound antibody with a sample containing the antigen; (3) contact the above with a secondary antibody bound to a detectable moiety (e.g., horseradish peroxidase enzyme or alkaline phosphatase enzyme); (4) contact the above with the substrate for the enzyme; (5) contact the above with a color reagent; (6) observe the color change.

An antibody can include antibody fragments such as Fab fragments, which retain the binding activity. Antibodies can be made as described in, e.g., Harlow and Lane, Antibodies: A Laboratory Manual, Cold Spring Harbor Laboratory, Cold Spring Harbor, N.Y. (1988). Briefly, purified antigen can be injected into an animal in an amount and in intervals sufficient to elicit an immune response. Antibodies can either be purified directly, or spleen cells can be obtained from the animal. The cells are then fused with an immortal cell line and screened for antibody secretion. Individual hybridomas are then propagated as individual clones serving as a source for a particular monoclonal antibody.

Optionally, the antibody is a monoclonal antibody. The term monoclonal antibody as used herein refers to an antibody from a substantially homogeneous population of antibodies, i.e., the individual antibodies comprising the population are identical except for possible naturally occurring mutations that may be present in minor amounts. Monoclonal antibodies may be prepared using hybridoma methods, such as those described by Kohler and Milstein, Nature, 256:495 (1975) or Harlow and Lane, Antibodies, A Laboratory Manual, Cold Spring Harbor Publications, New York (1988). In a hybridoma method, a mouse or other appropriate host animal is typically immunized with an immunizing agent to elicit lymphocytes that produce or are capable of producing antibodies that will specifically bind to the immunizing agent. Alternatively, the lymphocytes may be immunized in vitro.

Additionally provided is a method of screening a cell for infectivity by Negevirus, comprising contacting the cell with Negevirus and detecting the presence of Negevirus in the cells. Negevirus particles can be detected using any standard physical or biochemical methods. For example, physical methods that can be used for this detection include DNA based methods such as (1) polymerase chain reaction (PCR) for viral RNA or (2) direct hybridization with labeled probes, and immunological methods such as by (3) antibody directed against the viral structural or non-structural proteins. Reporter genes can also be utilized to detect cells that transduce Negevirus. For example, β-gal, green fluorescent protein or luciferase can be inserted into a recombinant Negevirus. The cell can then be contacted with the recombinant Negevirus, either in vitro or in vivo and a colorimetric assay could detect a color change in the cells that would indicate transduction of Negevirus in the cell. Additional detection methods are outlined in Fields, Virology, Raven Press, New York, N.Y. 1996.

V. Kits

Also provided are kits for performing nucleic acid assays and/or immunoassays as described herein. The kits comprise a Negevirus specific reagent. The Negevirus specific reagent can be a polynucleotide, such as a nucleic acid primer or probe; or a polypeptide, peptide or antibody. The kit can further comprise an assay substrate (e.g., a plate, a membrane, and a well) and/or other reagents. Optionally, the kit can further comprise a control sample.

Optionally, the kit can comprise isolated antibodies described herein. The kit can further comprise a Negevirus specific antibody. Optionally, the kit can comprise as assay substrate. Optionally, the kit can further comprise a control sample. The control sample can comprise one or more Negevirus.

VI. Examples

The following examples as well as the figures are included to demonstrate preferred embodiments of the invention. It should be appreciated by those of skill in the art that the techniques disclosed in the examples or figures represent techniques discovered by the inventors to function well in the practice of the invention, and thus can be considered to constitute preferred modes for its practice. However, those of skill in the art should, in light of the present disclosure, appreciate that many changes can be made in the specific embodiments which are disclosed and still obtain a like or similar result without departing from the spirit and scope of the invention.

Example 1

Negevirus

A Proposed New Taxon of Insect-Specific Viruses with Wide Geographic Distribution A. Materials and Methods Viruses.

All viruses used in this study were obtained from the World Reference Center for Emerging Viruses and Arboviruses (WRCEVA) at the University of Texas Medical Branch. The proposed names, original sources and geographic origins of the viruses included in the study are listed in Table 1.

Negev (NEGV) strain E0329 SEQ ID NO:7, the prototype strain of Negev virus, was initially isolated from a pool of *Anopheles coustani* mosquitoes collected in the Negev Desert, Israel in 1983.

Negev strains M30957 (SEQ ID NO:3) and M33056 (SEQ ID NO:6) were isolated at the WRCEVA from pools of *Culex coronator* and *Cx. quinquefasciatus* mosquitoes, respectively, collected in Houston, Harris County, Tex. in 2008.

Piura (PIUV) strain P60 (SEQ ID NO:8) was isolated at the Naval Medical Research Unit #6, Lima, Peru from a pool of *Culex* species mosquitoes collected in Piura, Peru in 1996.

Loreto (LORV) strain 3940-83 (SEQ ID NO:11) was isolated from a pool of *Anopheles albimanus* mosquitoes collected in Lima, Peru in 1983.

Loreto strain PeAR 2612/77 (SEQ ID NO: 15) was isolated from a pool of *Culex* spp. mosquitoes collected in Iquitos, Loreto, Peru in 1977.

Loreto strain 2617/77 (SEQ ID NO: 14) was isolated from a pool of phlebotomine sandflies (*Lutzomyia* spp.) collected in Iquitos, Peru in 1977.

Dezidougou (DEZV) strain ArA 20086 (SEQ ID NO: 16) was isolated at the Institute Pasteur, Dakar, Senegal from a pool of *Aedes aegypti* collected in Dezidougou, Ivory Coast in 1987.

Santana (SANV) strain BeAR 517449 (SEQ ID NO: 19) was isolated at the WRCEVA from a pool of *Culex* species mosquitoes originally collected in Santana, Amapa, Brazil in 1992.

Ngewotan (NWTV) strain JKT 9982 was isolated at the Naval Medical Research #2, Jakarta, Indonesia from a pool of *Cx. vishnui* collected at Wotan, Central Java, Indonesia in 1981.

All viruses were initially isolated from triturated pools of field-collected mosquitoes collected during arbovirus surveillance studies. The mosquito homogenates were inoculated into cultures of the C6/36 line of *Ae. albopictus* cells (Igarashi, 1978, *Journal of General Virology* 40:531-544) or the AP-61 line of *Ae. Pseudoscutellaris* (Varma et al., 1974, *Transactions of the Royal Society of Tropical Medicine and Hygiene* 68:374-382). After inoculation, cultures were maintained in incubators at a constant temperature of 28 C and observed at regular intervals for evidence of viral cytopathic effect (CPE)(Kim et al., 2009, *Virology* 386:154-159).

Before sequencing, all virus stocks were grown in cultures of the C6/36 clone of *Ae. albopictus* cells (Igarashi, 1978, *Journal of General Virology* 40:531-544), obtained from the American Type Culture Collection (ATCC), Manassas, Va. Infection was characterized by detachment of cells and cell lysis. Plaque assays were performed using the C7/10 (LTC-7) clone of *Ae. albopictus* cells (Sarver and Stollar, 1977, *Virology* 80:390-400).

Nucleotide Sequence Accession Numbers.

The genomic sequences of CiLV-C are available in GenBank Accession numbers NC 008169, DQ388512, and DQ157466, and were included in the phylogenetic analyses.

Cell Lines Utilized for Virus Replication Kinetics.

African green monkey kidney (Vero), baby hamster kidney (BHK-21), human embryonic kidney (HEK-293), *Drosophila melanogaster* and *Ae. albopictus* (C6/36 and C7/10) cell lines were obtained from the ATCC. *Anopheles albimanus, An. gambiae, Cx. tarsalis* and *Phlebotomus papatasi* cells were obtained from the WRCEVA (Bello Garcia et al., 1995, *Memorias do Instituto Oswaldo Cruz* 90:547-551; Chao and Ball, 1976, p. 263-266. In Kurstak and Maramorosch (ed.), *Invertebrate Tissue Culture Applications in Medicine, Biology and Agriculture*. Academic press, New York; Marhoul and Pudney, 1972, *Transactions of the Royal Society of Tropical Medicine and Hygiene* 66:183-184). Monolayers of Vero, BHK-21 and HEK-293 were grown at 37° C. in Dulbecco's minimal essential medium (DMEM) (4.5 g/L D-Glucose) with 10% heat-inactivated fetal bovine serum (FBS) and 1% penicillin/streptomycin. C6/36, C7/10, *An. albimanus, An. gambiae*, and *Cx. tarsalis* were grown at 28° C. in Dulbecco's minimal essential medium (DMEM) (4.5 g/L D-Glucose) with 10% heat-inactivated FBS, 1% penicillin/streptomycin and 1% tryptose phosphate broth (TPB). *Phlebotomus papatasi* cells were maintained in Schneider's medium (Sigma, St. Louis, Mo.) supplemented with 10% fetal bovine serum and Penicillin (100 units/mL)-Streptomycin (100 µg/ml). All 3 vertebrate and invertebrate cell lines were propagated in 6-well plates, and infected with a multiplicity of infection (MOI) of 10 in duplicate. Plates with vertebrate cells were incubated for one hour with periodic gentle rocking at 37° C., whereas plates containing invertebrate cells were incubated at 28° C. After three washes with PBS to remove unabsorbed virus, 2 ml of complete cell media were then added to each well, and plates were incubated at 28° C. or 37° C. for the invertebrate or vertebrate cell lines respectively. Virus from individual dishes was harvested at designated time-points for 3 days post infection (p.i.), clarified by low speed centrifugation, and the virus titer was determined by plaque assay in C7/10 cells. Virus yield at each time-point was recorded as PFU/cell, represented as the ratio of the total amount of virus present in the sample by the number of cells originally infected.

Virus Purification.

Virus purification was performed as previously described (Sherman and Weaver, 2010, *J Virol* 84:9775-9782). Virus was amplified on C7/10 cells at MOI of 0.5, harvested 48 hpi and clarified by centrifugation at 2,000 g for 10 min. Virus was precipitated overnight at 4° C. by adding polyethylene glycol and NaCl to 7% and 2.3% (wt/vol) concentrations, respectively. Virus was pelleted by centrifugation at 4,000×g for 30 min at 4° C., and the precipitate was then resuspended in TEN buffer (0.05 M Tris-HCl, pH 7.4, 0.1 M NaCl, 0.001 M EDTA) and loaded onto a 20-to-70% continuous sucrose (wt/vol) gradient in TEN buffer and centrifuged at 270,000 g for 1 hr. Following centrifugation, the visible virus band was harvested using a Pasteur pipette and centrifuged 4 times through an Amicon Ultra-4 100-kDa-cutoff filter (Millipore) and resuspended in 1 mL of TEN buffer.

Transmission Electron Microscopy.

For ultrastructural analysis, infected cells C6/36 were fixed for at least 1 hr in a mixture of 2.5% formaldehyde prepared from paraformaldehyde powder, and 0.1% glutaraldehyde in 0.05M cacodylate buffer pH 7.3 to which 0.03% picric acid and 0.03% $CaCl_2$ were added. The monolayers were washed in 0.1 M cacodylate buffer. Cells were scraped and processed further as a pellet. The pellets were post-fixed in 1% $OsO_4$ in 0.1M cacodylate buffer pH 7.3 for 1 hr, washed with distilled water, and en bloc stained with 2% aqueous uranyl acetate for 20 min at 60° C. The pellets were dehydrated in ethanol, processed through propylene oxide and embedded in Poly/Bed 812 (Polysciences, Warrington, Pa.). Ultrathin sections were cut on Leica EM UC7 ultramicrotome (Leica Microsystems, Buffalo Grove, Ill.), stained with lead citrate and examined in a Philips 201 transmission electron microscope at 60 kV.

Purified virus particles were also allowed to adhere to a Formvar carbon-coated copper grid for 10 min, negatively stained with either 2% aqueous uranyl acetate for 30 sec or 2% phosphotungstic acid with pH adjusted to 6.8 with 1N KOH (30 sec), and then examined in the electron microscope.

Plaque Assay.

Virus titrations were performed on confluent C7/10 cell monolayers in 6-well plates. Duplicate wells were inoculated with 0.1-ml aliquots of serial 10-fold dilutions of virus in growth medium. An additional 0.4 mL of growth media was added to each well to prevent cell desiccation, and virus was adsorbed for 2 hrs. Following incubation, the virus inoculum was removed by aspiration, and cell monolayers were overlaid with 3 mL of a medium 1:1 mixture of 2% tragacanth and 2×MEM with 5% FBS, 2% tryptose phosphate broth solution, 2% of a 100× solution of penicillin and streptomycin. Cells were incubated at 28° C. in 5% $CO_2$ for 2 days to allow plaque development and then the overlay was removed and monolayers were fixed with 3 mL of 10% formaldehyde in PBS for 30 mins. Cells were subsequently stained with 2% crystal violet in 30% methanol for 5 min at RT; excess stain was removed under running water and plaques were counted and recorded as the number of plaques per ml of inoculum.

Experimental Infection of Mosquitoes with Negev Virus.

Laboratory colonies of *Ae. aegypti* and *Ae. albopictus* were used for experimental infections. The progenitors of both colonies were originally collected in Thailand and had been maintained in an insectary for about 10 generations. Six-to-10 days after emergence, cohorts of 100 females of each species were allowed to feed on artificial blood meals containing three different concentrations (5, 7, and 9 $\log_{10}$ PFU/ml) of Negev virus strain EO-239 made by serially diluting a virus stock of known titer in defibrinated sheep blood (Colorado Serum Company, Denver, Colo.) in MEM. Artificial blood meals were placed in vials covered with mouse skin and were warmed to 37° C. using a Hemotek feeder (Discovery Workshops, Accrington, UK). Mosquitoes were allowed to feed for one hour, and were then cold-anesthetized on ice for sorting. Engorged females were removed and placed in cages and maintained with 10% sucrose at 28° C. with a relative humidity of ~70%. Fourteen days after feeding, mosquitoes were cold-anesthetized, and the legs and wings were removed. Mosquito bodies and legs/wings were put in individual tubes containing 500 µL MEM with 10% FBS and a stainless steel bead for trituration. Each body and leg/wing sample was homogenized for 4 minutes using a Mixer Mill 300 (Retsch, Haan, Germany). Samples were centrifuged for 10 min at 5,000 rpm, and 100 ml of each sample supernatant were inoculated into individual 24-well plates containing C7/10 cells. Cultures were maintained with 2 ml of medium at 28° C. and 5% $CO_2$. CPE observed in C7/10 cultures was used as a surrogate indicator for the presence of virus.

Genome Sequencing.

All virus sequences were obtained using 454 pyrosequencing (Roche Life Sciences, Branford, Conn.), except for the Dezidougou genomic sequences which were obtained by Illumina sequencing (Illumina, San Diego, Calif.).

Pyrosequencing.

RNA was extracted from virus stocks using TRIzol LS (Invitrogen, Carlsbad, Calif., USA) and treated with DNase I (DNA-Free, Ambion, Austin, Tex., USA). cDNA was generated using the Superscript II system (Invitrogen) employing random hexamers linked to an arbitrary 17-mer primer sequence (Palacios et al., 2007, *Emerg Infect Dis* 13:73-81). Resulting cDNA was treated with RNase H and then randomly amplified by PCR with a 9:1 mixture of primer corresponding to the 17-mer sequence and the random hexamer linked 17-mer primer (Palacios et al., 2007, *Emerg Infect Dis* 13:73-81). Products greater than 70 base pairs (bp) were selected by column chromatography (MinElute, Qiagen, Hilden, Germany) and ligated to specific adapters for sequencing on the 454 Genome Sequencer FLX (454 Life Sciences, Branford, Conn., USA) without fragmentation (Cox-Foster et al., 2007, Science 318:283-287; Margulies et al., 2005, Nature 437:376-380; Palacios et al., 2008, N Engl J Med 358:991-998). Software programs accessible through the analysis applications at the GreenePortal website at URL tako.cpmc.columbia.edu/Tools/ were used for removal of primer sequences, redundancy filtering, and sequence assembly. Sequence gaps were completed by RT-PCR amplification using primers based on pyrosequencing data. Amplification products were size-fractionated on 1% agarose gels, purified (MiniElute, Qiagen, Hilden, Germany), and directly sequenced in both directions with ABI PRISM Big Dye Terminator 1.1 Cycle Sequencing kits on ABI PRISM 3700 DNA Analyzers (Perkin-Elmer Applied Biosystems, Foster City, Calif.). The terminal sequences for each virus were amplified using the Clontech SMARTer RACE kit (Clontech, Mountain View, Calif., USA). Genome sequences were verified by Sanger dideoxy sequencing using primers designed from the draft sequence to create products of 1,000 bp with 500 bp overlaps.

Illumina Sequencing.

Viral RNA (0.1-0.2 µg) was fragmented by incubation at 94° C. for eight minutes in 19.5 µl of fragmentation buffer (Illumina 15016648). First and second strand synthesis, adapter ligation and amplification of the library were performed using the Illumina TruSeq RNA Sample Preparation kit under conditions prescribed by the manufacturer (Illumina, San Diego, Calif.). Samples were tracked using the "index tags" incorporated into the adapters as defined by the manufacturer. Cluster formation of the library DNA templates was performed using the TruSeq PE Cluster Kit v3 (Illumina, San Diego, Calif.) and the Illumina cBot workstation using conditions recommended by the manufacturer. Paired end 50 base sequencing by synthesis was performed using TruSeq SBS kit v3 (Illumina, San Diego, Calif.) on an Illumina HiSeq 1000 using protocols defined by the manufacturer. Cluster density per lane was 645-980 k/mm$^2$ and post filter reads ranged from 148-178 million per lane. Base call conversion to sequence reads was performed using CASAVA-1.8.2. Virus sequences were edited and assembled using the SeqMan and NextGen modules of the DNAStar Lasergene 7 program (Bioinformatics Pioneer DNAStar, Inc., Madison, Wis.). In certain cases, pre-filtering of reads to remove host sequence enhanced the assembly process.

RNA Analysis.

C7/10 cell monolayers were infected with Negev and Piura viruses at a MOI of 10. [$^3$H]uridine (20 µCi/ml) was added 1-hour post infection (hpi) or 24 hpi respectively, and incubated for additional 24 hours. Supernatants were harvested and virus was purified via rate-zonal centrifugation (see below). Viral RNA was isolated by TRIzol LS (Invitrogen, Grand Island, N.Y.), denatured with glyoxal in dimethyl sulfoxide and analyzed by agarose gel electrophoresis, using previously described conditions (Gorchakov et al., 2004, J Virol 78:61-75).

Genomic Analysis.

The genome of Negev strain E0329 was used to determine protein domains. The genome was translated into proteins and then submitted to NCBI conserved domain prediction tool at URL ncbi.nlm.nih.gov/Structure/cdd/wrpsb.cgi. The nucleotide and protein identities for the ORFs of all of the ten viruses generated were determined in EnzymeX (EnzymeX, Aalsmeer, Netherlands).

Phylogenetic Analysis.

Completed genomes of the 10 sequences were first aligned using translated protein sequences before being toggled back to nucleotides while maintaining the alignment. To determine areas of alignment that had sufficient confidence to determine phylogenetic relationships the alignment was run using the GUIDENCE software (Penn et al., 2010, Nucleic Acids Research 38:W23-28; Penn et al., 2010, Molecular Biology and Evolution 27:1759-1767). Areas with sufficient confidence were selected for further phylogenetic analysis. The Phylogenetic analyses were undertaken using PAUP* version 4.0,10b (Swofford, D. 2000. PAUP*. Phylogenetic Analysis Using Parsimony (* and other methods). Version 4. Sinauer Associates, Sunderland, Mass.). The optimal evolutionary model for each data set was estimated from 56 models implemented using Modeltest version 3.06 (Posada and Crandall, 1998, Bioinformatics 14:817-818). An optimal maximum likelihood (ML) tree was then estimated using the appropriate model and a heuristic search with tree-bisection-reconstruction branch swapping and 10 replicates, estimating variable parameters from the data, where necessary. Bootstrap replicates were calculated for each dataset under the same models mentioned above. Bayesian analysis was undertaken using MrBayes v3.1 (Huelsenbeck and Ronquist, 2001, Bioinformatics 17:754-755; Ronquist and Huelsenbeck, 2003, Bioinformatics 19:1572-1574), and datasets were run for five hundred thousand generations until they reached congruence. The models used were HKY+G and HKY+I+G.

SEQUENCE LISTING (21 sequences)

SEQ ID NO: 1 - DNA, 11431 bp, Unknown
  unknown virus
  misc_feature (4)..(4): n is a, c, g, or t
  misc_feature (7)..(9): n is a, c, g, or t
  misc_feature (11)..(13): n is a, c, g, or t
  misc_feature (16)..(17): n is a, c, g, or t
  misc_feature (19)..(20): n is a, c, g, or t
  misc_feature (23)..(25): n is a, c, g, or t
  misc_feature (30)..(32): n is a, c, g, or t
  misc_feature (34)..(34): n is a, c, g, or t
  misc_feature (36)..(36): n is a, c, g, or t
  misc_feature (38)..(42): n is a, c, g, or t
  misc_feature (44)..(45): n is a, c, g, or t
  misc_feature (47)..(50): n is a, c, g, or t
  misc_feature (53)..(54): n is a, c, g, or t
  misc_feature (56)..(57): n is a, c, g, or t
  misc_feature (59)..(59): n is a, c, g, or t
  misc_feature (61)..(64): n is a, c, g, or t
  misc_feature (66)..(68): n is a, c, g, or t
  misc_feature (70)..(71): n is a, c, g, or t
  misc_feature (73)..(73): n is a, c, g, or t
  misc_feature (75)..(76): n is a, c, g, or t
  misc_feature (79)..(82): n is a, c, g, or t
  misc_feature (86)..(86): n is a, c, g, or t
  misc_feature (93)..(93): n is a, c, g, or t
  misc_feature (96)..(96): n is a, c, g, or t
  misc_feature (98)..(99): n is a, c, g, or t
  misc_feature (108)..(109): n is a, c, g, or t
  misc_feature (214)..(214): n is a, c, g, or t
  misc_feature (220)..(223): n is a, c, g, or t
  misc_feature (225)..(225): n is a, c, g, or t
  misc_feature (228)..(228): n is a, c, g, or t
  misc_feature (230)..(230): n is a, c, g, or t
  misc_feature (232)..(234): n is a, c, g, or t
  misc_feature (236)..(237): n is a, c, g, or t
  misc_feature (239)..(239): n is a, c, g, or t
  misc_feature (241)..(245): n is a, c, g, or t
  misc_feature (247)..(248): n is a, c, g, or t
  misc_feature (250)..(252): n is a, c, g, or t
  misc_feature (254)..(254): n is a, c, g, or t
  misc_feature (256)..(260): n is a, c, g, or t
  misc_feature (263)..(263): n is a, c, g, or t
  misc_feature (288)..(289): n is a, c, g, or t
  misc_feature (291)..(293): n is a, c, g, or t
  misc_feature (295)..(297): n is a, c, g, or t
  misc_feature (299)..(299): n is a, c, g, or t
  misc_feature (301)..(304): n is a, c, g, or t
  misc_feature (308)..(308): n is a, c, g, or t
  misc_feature (311)..(311): n is a, c, g, or t
  misc_feature (316)..(318): n is a, c, g, or t
  misc_feature (320)..(322): n is a, c, g, or t
  misc_feature (325)..(332): n is a, c, g, or t
  misc_feature (336)..(338): n is a, c, g, or t
  misc_feature (340)..(340): n is a, c, g, or t
  misc_feature (343)..(348): n is a, c, g, or t
  misc_feature (359)..(361): n is a, c, g, or t
  misc_feature (363)..(369): n is a, c, g, or t
  misc_feature (375)..(375): n is a, c, g, or t
  misc_feature (377)..(378): n is a, c, g, or t
  misc_feature (380)..(380): n is a, c, g, or t
  misc_feature (382)..(386): n is a, c, g, or t
  misc_feature (389)..(389): n is a, c, g, or t
  misc_feature (392)..(392): n is a, c, g, or t
  misc_feature (396)..(398): n is a, c, g, or t
  misc_feature (401)..(403): n is a, c, g, or t
  misc_feature (441)..(442): n is a, c, g, or t
  misc_feature (444)..(444): n is a, c, g, or t
  misc_feature (447)..(448): n is a, c, g, or t
  misc_feature (452)..(452): n is a, c, g, or t
  misc_feature (455)..(455): n is a, c, g, or t
  misc_feature (457)..(457): n is a, c, g, or t
  misc_feature (466)..(468): n is a, c, g, or t
  misc_feature (473)..(474): n is a, c, g, or t
  misc_feature (479)..(480): n is a, c, g, or t
  misc_feature (482)..(485): n is a, c, g, or t
  misc_feature (487)..(487): n is a, c, g, or t
  misc_feature (490)..(493): n is a, c, g, or t
  misc_feature (497)..(500): n is a, c, g, or t
  misc_feature (503)..(503): n is a, c, g, or t
  misc_feature (507)..(507): n is a, c, g, or t
  misc_feature (515)..(516): n is a, c, g, or t
  misc_feature (737)..(737): n is a, c, g, or t
  misc_feature (769)..(769): n is a, c, g, or t
  misc_feature (774)..(774): n is a, c, g, or t
  misc_feature (776)..(777): n is a, c, g, or t
  misc_feature (779)..(780): n is a, c, g, or t
  misc_feature (782)..(783): n is a, c, g, or t
  misc_feature (786)..(786): n is a, c, g, or t
  misc_feature (788)..(788): n is a, c, g, or t
  misc_feature (792)..(792): n is a, c, g, or t
  misc_feature (794)..(795): n is a, c, g, or t
  misc_feature (798)..(798): n is a, c, g, or t
  misc_feature (800)..(801): n is a, c, g, or t
  misc_feature (803)..(803): n is a, c, g, or t
  misc_feature (806)..(808): n is a, c, g, or t
  misc_feature (810)..(812): n is a, c, g, or t
  misc_feature (819)..(821): n is a, c, g, or t
  misc_feature (823)..(824): n is a, c, g, or t
  misc_feature (827)..(827): n is a, c, g, or t
  misc_feature (829)..(830): n is a, c, g, or t
  misc_feature (832)..(833): n is a, c, g, or t
  misc_feature (836)..(837): n is a, c, g, or t
  misc_feature (840)..(843): n is a, c, g, or t
  misc_feature (849)..(851): n is a, c, g, or t
  misc_feature (853)..(855): n is a, c, g, or t
  misc_feature (858)..(858): n is a, c, g, or t
  misc_feature (860)..(860): n is a, c, g, or t
  misc_feature (863)..(864): n is a, c, g, or t
  misc_feature (866)..(867): n is a, c, g, or t
  misc_feature (869)..(870): n is a, c, g, or t
  misc_feature (872)..(872): n is a, c, g, or t
  misc_feature (874)..(875): n is a, c, g, or t
  misc_feature (877)..(879): n is a, c, g, or t
  misc_feature (881)..(882): n is a, c, g, or t
  misc_feature (884)..(887): n is a, c, g, or t
  misc_feature (890)..(890): n is a, c, g, or t
  misc_feature (893)..(894): n is a, c, g, or t
  misc_feature (896)..(896): n is a, c, g, or t
  misc_feature (900)..(904): n is a, c, g, or t
  misc_feature (908)..(912): n is a, c, g, or t
  misc_feature (918)..(919): n is a, c, g, or t
  misc_feature (921)..(921): n is a, c, g, or t
  misc_feature (923)..(925): n is a, c, g, or t
  misc_feature (927)..(927): n is a, c, g, or t
  misc_feature (929)..(934): n is a, c, g, or t
  misc_feature (936)..(937): n is a, c, g, or t
  misc_feature (939)..(939): n is a, c, g, or t
  misc_feature (941)..(941): n is a, c, g, or t
  misc_feature (945)..(946): n is a, c, g, or t
  misc_feature (948)..(951): n is a, c, g, or t
  misc_feature (953)..(953): n is a, c, g, or t
  misc_feature (956)..(956): n is a, c, g, or t
  misc_feature (960)..(960): n is a, c, g, or t
  misc_feature (963)..(965): n is a, c, g, or t
  misc_feature (968)..(969): n is a, c, g, or t
  misc_feature (974)..(974): n is a, c, g, or t
  misc_feature (976)..(976): n is a, c, g, or t
  misc_feature (978)..(978): n is a, c, g, or t
  misc_feature (980)..(980): n is a, c, g, or t
  misc_feature (986)..(986): n is a, c, g, or t
  misc_feature (989)..(990): n is a, c, g, or t
  misc_feature (992)..(993): n is a, c, g, or t
  misc_feature (996)..(997): n is a, c, g, or t
  misc_feature (999)..(1000): n is a, c, g, or t
  misc_feature (1004)..(1005): n is a, c, g, or t
  misc_feature (1008)..(1008): n is a, c, g, or t
  misc_feature (1010)..(1013): n is a, c, g, or t
  misc_feature (1019)..(1022): n is a, c, g, or t
  misc_feature (1028)..(1028): n is a, c, g, or t
  misc_feature (1031)..(1031): n is a, c, g, or t
  misc_feature (1049)..(1049): n is a, c, g, or t
  misc_feature (1051)..(1051): n is a, c, g, or t
  misc_feature (1059)..(1061): n is a, c, g, or t
  misc_feature (1064)..(1064): n is a, c, g, or t
  misc_feature (1066)..(1067): n is a, c, g, or t
  misc_feature (1069)..(1069): n is a, c, g, or t
  misc_feature (1073)..(1073): n is a, c, g, or t
  misc_feature (1077)..(1077): n is a, c, g, or t
  misc_feature (1079)..(1079): n is a, c, g, or t
  misc_feature (1082)..(1084): n is a, c, g, or t
  misc_feature (1088)..(1088): n is a, c, g, or t
  misc_feature (1092)..(1092): n is a, c, g, or t
  misc_feature (1094)..(1095): n is a, c, g, or t
  misc_feature (1098)..(1099): n is a, c, g, or t
  misc_feature (1103)..(1103): n is a, c, g, or t
  misc_feature (1106)..(1110): n is a, c, g, or t
  misc_feature (1112)..(1112): n is a, c, g, or t
  misc_feature (1116)..(1116): n is a, c, g, or t
  misc_feature (1118)..(1119): n is a, c, g, or t
  misc_feature (1121)..(1121): n is a, c, g, or t
  misc_feature (1123)..(1125): n is a, c, g, or t
  misc_feature (1127)..(1130): n is a, c, g, or t
  misc_feature (1136)..(1136): n is a, c, g, or t
  misc_feature (1140)..(1142): n is a, c, g, or t
  misc_feature (1144)..(1148): n is a, c, g, or t
  misc_feature (1152)..(1154): n is a, c, g, or t
  misc_feature (1157)..(1157): n is a, c, g, or t
  misc_feature (1160)..(1163): n is a, c, g, or t
  misc_feature (1166)..(1166): n is a, c, g, or t
  misc_feature (1169)..(1169): n is a, c, g, or t
  misc_feature (1174)..(1175): n is a, c, g, or t
  misc_feature (1178)..(1178): n is a, c, g, or t
  misc_feature (1196)..(1196): n is a, c, g, or t
  misc_feature (1199)..(1199): n is a, c, g, or t
  misc_feature (1202)..(1203): n is a, c, g, or t
  misc_feature (1205)..(1205): n is a, c, g, or t
  misc_feature (1208)..(1208): n is a, c, g, or t
  misc_feature (1214)..(1215): n is a, c, g, or t
  misc_feature (1217)..(1220): n is a, c, g, or t
  misc_feature (1226)..(1229): n is a, c, g, or t
  misc_feature (1235)..(1235): n is a, c, g, or t
  misc_feature (1241)..(1241): n is a, c, g, or t
  misc_feature (1246)..(1247): n is a, c, g, or t
  misc_feature (1250)..(1251): n is a, c, g, or t
  misc_feature (1253)..(1253): n is a, c, g, or t
  misc_feature (1256)..(1256): n is a, c, g, or t
  misc_feature (1259)..(1259): n is a, c, g, or t
  misc_feature (1262)..(1262): n is a, c, g, or t
  misc_feature (1283)..(1285): n is a, c, g, or t
  misc_feature (1289)..(1293): n is a, c, g, or t
  misc_feature (1295)..(1295): n is a, c, g, or t
  misc_feature (1297)..(1298): n is a, c, g, or t
  misc_feature (1301)..(1301): n is a, c, g, or t
  misc_feature (1304)..(1306): n is a, c, g, or t
  misc_feature (1309)..(1309): n is a, c, g, or t
  misc_feature (1330)..(1330): n is a, c, g, or t
  misc_feature (1332)..(1332): n is a, c, g, or t
  misc_feature (1334)..(1335): n is a, c, g, or t
  misc_feature (1338)..(1338): n is a, c, g, or t
  misc_feature (1341)..(1343): n is a, c, g, or t
  misc_feature (1347)..(1353): n is a, c, g, or t
  misc_feature (1355)..(1357): n is a, c, g, or t
  misc_feature (1361)..(1361): n is a, c, g, or t
  misc_feature (1376)..(1378): n is a, c, g, or t
  misc_feature (1382)..(1384): n is a, c, g, or t
  misc_feature (1386)..(1386): n is a, c, g, or t
  misc_feature (1388)..(1391): n is a, c, g, or t
  misc_feature (1395)..(1395): n is a, c, g, or t
  misc_feature (1397)..(1397): n is a, c, g, or t
  misc_feature (1399)..(1400): n is a, c, g, or t
  misc_feature (1403)..(1403): n is a, c, g, or t
  misc_feature (1406)..(1406): n is a, c, g, or t
  misc_feature (1410)..(1410): n is a, c, g, or t
  misc_feature (1415)..(1415): n is a, c, g, or t
  misc_feature (1418)..(1418): n is a, c, g, or t
  misc_feature (1427)..(1427): n is a, c, g, or t
  misc_feature (1432)..(1433): n is a, c, g, or t
  misc_feature (1442)..(1444): n is a, c, g, or t
  misc_feature (1446)..(1448): n is a, c, g, or t
  misc_feature (1451)..(1451): n is a, c, g, or t
  misc_feature (1460)..(1460): n is a, c, g, or t
  misc_feature (1466)..(1466): n is a, c, g, or t
  misc_feature (1483)..(1483): n is a, c, g, or t
  misc_feature (1485)..(1488): n is a, c, g, or t
  misc_feature (1490)..(1490): n is a, c, g, or t
  misc_feature (1493)..(1493): n is a, c, g, or t
  misc_feature (1496)..(1496): n is a, c, g, or t
  misc_feature (1499)..(1499): n is a, c, g, or t
  misc_feature (1502)..(1502): n is a, c, g, or t
  misc_feature (1506)..(1506): n is a, c, g, or t
  misc_feature (1508)..(1511): n is a, c, g, or t
  misc_feature (1517)..(1517): n is a, c, g, or t
  misc_feature (1520)..(1522): n is a, c, g, or t
  misc_feature (1525)..(1526): n is a, c, g, or t
  misc_feature (1529)..(1529): n is a, c, g, or t
  misc_feature (1532)..(1532): n is a, c, g, or t
  misc_feature (1535)..(1535): n is a, c, g, or t
  misc_feature (1537)..(1539): n is a, c, g, or t
  misc_feature (1541)..(1541): n is a, c, g, or t
  misc_feature (1549)..(1549): n is a, c, g, or t
  misc_feature (1553)..(1556): n is a, c, g, or t
  misc_feature (1559)..(1559): n is a, c, g, or t
  misc_feature (1562)..(1562): n is a, c, g, or t
  misc_feature (1568)..(1568): n is a, c, g, or t
  misc_feature (1571)..(1574): n is a, c, g, or t
  misc_feature (1578)..(1580): n is a, c, g, or t
  misc_feature (1583)..(1584): n is a, c, g, or t
  misc_feature (1587)..(1587): n is a, c, g, or t
  misc_feature (1591)..(1593): n is a, c, g, or t
  misc_feature (1601)..(1602): n is a, c, g, or t
  misc_feature (1604)..(1604): n is a, c, g, or t
  misc_feature (1606)..(1607): n is a, c, g, or t
  misc_feature (1610)..(1610): n is a, c, g, or t
  misc_feature (1614)..(1614): n is a, c, g, or t
  misc_feature (1616)..(1617): n is a, c, g, or t
  misc_feature (1620)..(1624): n is a, c, g, or t
  misc_feature (1626)..(1627): n is a, c, g, or t
  misc_feature (1629)..(1636): n is a, c, g, or t
  misc_feature (1638)..(1638): n is a, c, g, or t
  misc_feature (1642)..(1642): n is a, c, g, or t
  misc_feature (1644)..(1645): n is a, c, g, or t
  misc_feature (1647)..(1648): n is a, c, g, or t
  misc_feature (1650)..(1650): n is a, c, g, or t
  misc_feature (1652)..(1652): n is a, c, g, or t
  misc_feature (1658)..(1658): n is a, c, g, or t
  misc_feature (1722)..(1724): n is a, c, g, or t
  misc_feature (1727)..(1731): n is a, c, g, or t
  misc_feature (1736)..(1739): n is a, c, g, or t
  misc_feature (1742)..(1743): n is a, c, g, or t
  misc_feature (1745)..(1745): n is a, c, g, or t
  misc_feature (1751)..(1751): n is a, c, g, or t
  misc_feature (1760)..(1763): n is a, c, g, or t
  misc_feature (1771)..(1771): n is a, c, g, or t
  misc_feature (1775)..(1775): n is a, c, g, or t
  misc_feature (1778)..(1778): n is a, c, g, or t
  misc_feature (1781)..(1781): n is a, c, g, or t
  misc_feature (1790)..(1793): n is a, c, g, or t
  misc_feature (1797)..(1798): n is a, c, g, or t
  misc_feature (1801)..(1802): n is a, c, g, or t
  misc_feature (1806)..(1806): n is a, c, g, or t
  misc_feature (1808)..(1808): n is a, c, g, or t
  misc_feature (1814)..(1814): n is a, c, g, or t
  misc_feature (1820)..(1820): n is a, c, g, or t
  misc_feature (1824)..(1825): n is a, c, g, or t
  misc_feature (1827)..(1827): n is a, c, g, or t
  misc_feature (1838)..(1839): n is a, c, g, or t
  misc_feature (1842)..(1848): n is a, c, g, or t
  misc_feature (1851)..(1852): n is a, c, g, or t
  misc_feature (1856)..(1859): n is a, c, g, or t
  misc_feature (1862)..(1862): n is a, c, g, or t
  misc_feature (1865)..(1865): n is a, c, g, or t
  misc_feature (1868)..(1869): n is a, c, g, or t
  misc_feature (1880)..(1881): n is a, c, g, or t
  misc_feature (1885)..(1886): n is a, c, g, or t
  misc_feature (1889)..(1889): n is a, c, g, or t
  misc_feature (1896)..(1896): n is a, c, g, or t
  misc_feature (1898)..(1898): n is a, c, g, or t
  misc_feature (1900)..(1901): n is a, c, g, or t
  misc_feature (1904)..(1904): n is a, c, g, or t
  misc_feature (1909)..(1909): n is a, c, g, or t
  misc_feature (1913)..(1914): n is a, c, g, or t
  misc_feature (1916)..(1916): n is a, c, g, or t
  misc_feature (1922)..(1922): n is a, c, g, or t
  misc_feature (1925)..(1925): n is a, c, g, or t
  misc_feature (1927)..(1927): n is a, c, g, or t
  misc_feature (1931)..(1932): n is a, c, g, or t
  misc_feature (1934)..(1934): n is a, c, g, or t
  misc_feature (1940)..(1940): n is a, c, g, or t
  misc_feature (1947)..(1947): n is a, c, g, or t
  misc_feature (1950)..(1950): n is a, c, g, or t
  misc_feature (1952)..(1952): n is a, c, g, or t
  misc_feature (1958)..(1958): n is a, c, g, or t
  misc_feature (1960)..(1960): n is a, c, g, or t
  misc_feature (1964)..(1964): n is a, c, g, or t
  misc_feature (1967)..(1968): n is a, c, g, or t
  misc_feature (1970)..(1971): n is a, c, g, or t
  misc_feature (1973)..(1973): n is a, c, g, or t
  misc_feature (1979)..(1979): n is a, c, g, or t
  misc_feature (1982)..(1983): n is a, c, g, or t
  misc_feature (1985)..(1985): n is a, c, g, or t
  misc_feature (1991)..(1991): n is a, c, g, or t
  misc_feature (1994)..(1995): n is a, c, g, or t
  misc_feature (1997)..(1997): n is a, c, g, or t
  misc_feature (2002)..(2003): n is a, c, g, or t
  misc_feature (2007)..(2009): n is a, c, g, or t
  misc_feature (2015)..(2015): n is a, c, g, or t
  misc_feature (2019)..(2019): n is a, c, g, or t
  misc_feature (2024)..(2027): n is a, c, g, or t
  misc_feature (2030)..(2030): n is a, c, g, or t
  misc_feature (2032)..(2034): n is a, c, g, or t
  misc_feature (2036)..(2036): n is a, c, g, or t
  misc_feature (2038)..(2044): n is a, c, g, or t
  misc_feature (2046)..(2046): n is a, c, g, or t
  misc_feature (2048)..(2053): n is a, c, g, or t
  misc_feature (2056)..(2057): n is a, c, g, or t
  misc_feature (2070)..(2072): n is a, c, g, or t
  misc_feature (2076)..(2079): n is a, c, g, or t
  misc_feature (2082)..(2082): n is a, c, g, or t
  misc_feature (2087)..(2087): n is a, c, g, or t
  misc_feature (2093)..(2097): n is a, c, g, or t
  misc_feature (2102)..(2102): n is a, c, g, or t
  misc_feature (2106)..(2108): n is a, c, g, or t
  misc_feature (2111)..(2112): n is a, c, g, or t
  misc_feature (2114)..(2114): n is a, c, g, or t
  misc_feature (2116)..(2117): n is a, c, g, or t
  misc_feature (2119)..(2120): n is a, c, g, or t
  misc_feature (2129)..(2129): n is a, c, g, or t
  misc_feature (2135)..(2136): n is a, c, g, or t
  misc_feature (2138)..(2138): n is a, c, g, or t
  misc_feature (2141)..(2142): n is a, c, g, or t
  misc_feature (2144)..(2144): n is a, c, g, or t
  misc_feature (2156)..(2157): n is a, c, g, or t
  misc_feature (2163)..(2163): n is a, c, g, or t
  misc_feature (2166)..(2166): n is a, c, g, or t
  misc_feature (2168)..(2168): n is a, c, g, or t
  misc_feature (2170)..(2171): n is a, c, g, or t
  misc_feature (2174)..(2174): n is a, c, g, or t
  misc_feature (2176)..(2176): n is a, c, g, or t
  misc_feature (2178)..(2180): n is a, c, g, or t
  misc_feature (2182)..(2183): n is a, c, g, or t
  misc_feature (2186)..(2186): n is a, c, g, or t
  misc_feature (2189)..(2189): n is a, c, g, or t
  misc_feature (2192)..(2192): n is a, c, g, or t
  misc_feature (2198)..(2198): n is a, c, g, or t
  misc_feature (2201)..(2201): n is a, c, g, or t
  misc_feature (2205)..(2206): n is a, c, g, or t
  misc_feature (2210)..(2210): n is a, c, g, or t
  misc_feature (2213)..(2217): n is a, c, g, or t
  misc_feature (2222)..(2223): n is a, c, g, or t
  misc_feature (2225)..(2225): n is a, c, g, or t
  misc_feature (2228)..(2228): n is a, c, g, or t
  misc_feature (2234)..(2234): n is a, c, g, or t
  misc_feature (2237)..(2238): n is a, c, g, or t
  misc_feature (2243)..(2243): n is a, c, g, or t
  misc_feature (2246)..(2246): n is a, c, g, or t
  misc_feature (2248)..(2248): n is a, c, g, or t
  misc_feature (2250)..(2253): n is a, c, g, or t
  misc_feature (2255)..(2256): n is a, c, g, or t
  misc_feature (2258)..(2258): n is a, c, g, or t
  misc_feature (2260)..(2262): n is a, c, g, or t
  misc_feature (2264)..(2264): n is a, c, g, or t
  misc_feature (2266)..(2266): n is a, c, g, or t
  misc_feature (2268)..(2268): n is a, c, g, or t
  misc_feature (2271)..(2271): n is a, c, g, or t
  misc_feature (2273)..(2273): n is a, c, g, or t
  misc_feature (2276)..(2276): n is a, c, g, or t
  misc_feature (2280)..(2280): n is a, c, g, or t
  misc_feature (2282)..(2283): n is a, c, g, or t
  misc_feature (2285)..(2285): n is a, c, g, or t
  misc_feature (2291)..(2292): n is a, c, g, or t
  misc_feature (2294)..(2297): n is a, c, g, or t
  misc_feature (2303)..(2303): n is a, c, g, or t
  misc_feature (2306)..(2306): n is a, c, g, or t
  misc_feature (2309)..(2309): n is a, c, g, or t
  misc_feature (2311)..(2312): n is a, c, g, or t
  misc_feature (2316)..(2316): n is a, c, g, or t
  misc_feature (2318)..(2319): n is a, c, g, or t
  misc_feature (2321)..(2324): n is a, c, g, or t
  misc_feature (2328)..(2328): n is a, c, g, or t
  misc_feature (2335)..(2336): n is a, c, g, or t
  misc_feature (2339)..(2339): n is a, c, g, or t
  misc_feature (2345)..(2345): n is a, c, g, or t
  misc_feature (2348)..(2348): n is a, c, g, or t
  misc_feature (2351)..(2351): n is a, c, g, or t
  misc_feature (2354)..(2356): n is a, c, g, or t
  misc_feature (2358)..(2360): n is a, c, g, or t
  misc_feature (2362)..(2362): n is a, c, g, or t
  misc_feature (2365)..(2365): n is a, c, g, or t
  misc_feature (2367)..(2372): n is a, c, g, or t
  misc_feature (2375)..(2375): n is a, c, g, or t
  misc_feature (2378)..(2381): n is a, c, g, or t
  misc_feature (2384)..(2384): n is a, c, g, or t
  misc_feature (2391)..(2393): n is a, c, g, or t
  misc_feature (2395)..(2400): n is a, c, g, or t
  misc_feature (2402)..(2403): n is a, c, g, or t
  misc_feature (2405)..(2407): n is a, c, g, or t
  misc_feature (2410)..(2412): n is a, c, g, or t
  misc_feature (2414)..(2414): n is a, c, g, or t
  misc_feature (2421)..(2423): n is a, c, g, or t
  misc_feature (2426)..(2430): n is a, c, g, or t
  misc_feature (2432)..(2442): n is a, c, g, or t
  misc_feature (2446)..(2449): n is a, c, g, or t
  misc_feature (2452)..(2454): n is a, c, g, or t
  misc_feature (2456)..(2462): n is a, c, g, or t
  misc_feature (2465)..(2465): n is a, c, g, or t
  misc_feature (2468)..(2468): n is a, c, g, or t
  misc_feature (2472)..(2475): n is a, c, g, or t
  misc_feature (2477)..(2479): n is a, c, g, or t
  misc_feature (2481)..(2482): n is a, c, g, or t
  misc_feature (2484)..(2484): n is a, c, g, or t
  misc_feature (2486)..(2486): n is a, c, g, or t
  misc_feature (2489)..(2489): n is a, c, g, or t
  misc_feature (2493)..(2493): n is a, c, g, or t
  misc_feature (2495)..(2496): n is a, c, g, or t
  misc_feature (2498)..(2502): n is a, c, g, or t
  misc_feature (2504)..(2507): n is a, c, g, or t
  misc_feature (2509)..(2509): n is a, c, g, or t
  misc_feature (2513)..(2514): n is a, c, g, or t
  misc_feature (2516)..(2516): n is a, c, g, or t
  misc_feature (2519)..(2521): n is a, c, g, or t
  misc_feature (2525)..(2525): n is a, c, g, or t
  misc_feature (2550)..(2553): n is a, c, g, or t
  misc_feature (2555)..(2555): n is a, c, g, or t
  misc_feature (2557)..(2558): n is a, c, g, or t
  misc_feature (2561)..(2562): n is a, c, g, or t
  misc_feature (2564)..(2564): n is a, c, g, or t
  misc_feature (2567)..(2567): n is a, c, g, or t
  misc_feature (2570)..(2571): n is a, c, g, or t
  misc_feature (2573)..(2579): n is a, c, g, or t
  misc_feature (2582)..(2583): n is a, c, g, or t
  misc_feature (2587)..(2588): n is a, c, g, or t
  misc_feature (2591)..(2592): n is a, c, g, or t
  misc_feature (2595)..(2595): n is a, c, g, or t
  misc_feature (2597)..(2597): n is a, c, g, or t
  misc_feature (2600)..(2600): n is a, c, g, or t
  misc_feature (2605)..(2606): n is a, c, g, or t
  misc_feature (2610)..(2613): n is a, c, g, or t
  misc_feature (2621)..(2625): n is a, c, g, or t
  misc_feature (2627)..(2630): n is a, c, g, or t
  misc_feature (2632)..(2632): n is a, c, g, or t
  misc_feature (2636)..(2637): n is a, c, g, or t
  misc_feature (2639)..(2639): n is a, c, g, or t
  misc_feature (2642)..(2643): n is a, c, g, or t
  misc_feature (2648)..(2648): n is a, c, g, or t
  misc_feature (2654)..(2654): n is a, c, g, or t
  misc_feature (2657)..(2657): n is a, c, g, or t
  misc_feature (2660)..(2662): n is a, c, g, or t
  misc_feature (2664)..(2664): n is a, c, g, or t
  misc_feature (2666)..(2669): n is a, c, g, or t
  misc_feature (2672)..(2672): n is a, c, g, or t
  misc_feature (2674)..(2686): n is a, c, g, or t
  misc_feature (2688)..(2688): n is a, c, g, or t
  misc_feature (2690)..(2697): n is a, c, g, or t
  misc_feature (2699)..(2703): n is a, c, g, or t
  misc_feature (2705)..(2705): n is a, c, g, or t
  misc_feature (2708)..(2712): n is a, c, g, or t
  misc_feature (2714)..(2715): n is a, c, g, or t
  misc_feature (2717)..(2727): n is a, c, g, or t
  misc_feature (2737)..(2737): n is a, c, g, or t
  misc_feature (2739)..(2742): n is a, c, g, or t
  misc_feature (2744)..(2744): n is a, c, g, or t
  misc_feature (2750)..(2750): n is a, c, g, or t
  misc_feature (2754)..(2754): n is a, c, g, or t
  misc_feature (2756)..(2756): n is a, c, g, or t
  misc_feature (2759)..(2761): n is a, c, g, or t
  misc_feature (2763)..(2765): n is a, c, g, or t
  misc_feature (2772)..(2772): n is a, c, g, or t
  misc_feature (2774)..(2776): n is a, c, g, or t
  misc_feature (2778)..(2783): n is a, c, g, or t
  misc_feature (2785)..(2785): n is a, c, g, or t
  misc_feature (2789)..(2789): n is a, c, g, or t
  misc_feature (2791)..(2791): n is a, c, g, or t
  misc_feature (2794)..(2794): n is a, c, g, or t
  misc_feature (2797)..(2797): n is a, c, g, or t
  misc_feature (2799)..(2799): n is a, c, g, or t
  misc_feature (2802)..(2803): n is a, c, g, or t
  misc_feature (2805)..(2805): n is a, c, g, or t
  misc_feature (2808)..(2811): n is a, c, g, or t
  misc_feature (2813)..(2813): n is a, c, g, or t
  misc_feature (2817)..(2822): n is a, c, g, or t
  misc_feature (2826)..(2826): n is a, c, g, or t
  misc_feature (2833)..(2835): n is a, c, g, or t
  misc_feature (2837)..(2837): n is a, c, g, or t
  misc_feature (2844)..(2844): n is a, c, g, or t
  misc_feature (2847)..(2847): n is a, c, g, or t
  misc_feature (2849)..(2851): n is a, c, g, or t
  misc_feature (2854)..(2855): n is a, c, g, or t
  misc_feature (2858)..(2858): n is a, c, g, or t
  misc_feature (2860)..(2861): n is a, c, g, or t
  misc_feature (2864)..(2864): n is a, c, g, or t
  misc_feature (2867)..(2867): n is a, c, g, or t
  misc_feature (2871)..(2871): n is a, c, g, or t
  misc_feature (2877)..(2877): n is a, c, g, or t
  misc_feature (2879)..(2879): n is a, c, g, or t
  misc_feature (2885)..(2885): n is a, c, g, or t
  misc_feature (2888)..(2889): n is a, c, g, or t
  misc_feature (2894)..(2894): n is a, c, g, or t
  misc_feature (2898)..(2900): n is a, c, g, or t
  misc_feature (2903)..(2905): n is a, c, g, or t
  misc_feature (2911)..(2912): n is a, c, g, or t
  misc_feature (2914)..(2916): n is a, c, g, or t
  misc_feature (2918)..(2919): n is a, c, g, or t
  misc_feature (2922)..(2923): n is a, c, g, or t
  misc_feature (2925)..(2925): n is a, c, g, or t
  misc_feature (2930)..(2931): n is a, c, g, or t
  misc_feature (2933)..(2933): n is a, c, g, or t
  misc_feature (2936)..(2938): n is a, c, g, or t
  misc_feature (2942)..(2942): n is a, c, g, or t
  misc_feature (2945)..(2948): n is a, c, g, or t
  misc_feature (2951)..(2951): n is a, c, g, or t
  misc_feature (2957)..(2957): n is a, c, g, or t
  misc_feature (2960)..(2960): n is a, c, g, or t
  misc_feature (2963)..(2965): n is a, c, g, or t
  misc_feature (2967)..(2967): n is a, c, g, or t
  misc_feature (2969)..(2970): n is a, c, g, or t
  misc_feature (2973)..(2975): n is a, c, g, or t
  misc_feature (2979)..(2980): n is a, c, g, or t
  misc_feature (2982)..(2982): n is a, c, g, or t
  misc_feature (2985)..(2989): n is a, c, g, or t
  misc_feature (2991)..(2991): n is a, c, g, or t
  misc_feature (2993)..(2996): n is a, c, g, or t
  misc_feature (2998)..(3000): n is a, c, g, or t
  misc_feature (3002)..(3003): n is a, c, g, or t
  misc_feature (3005)..(3006): n is a, c, g, or t
  misc_feature (3008)..(3008): n is a, c, g, or t
  misc_feature (3010)..(3010): n is a, c, g, or t
  misc_feature (3014)..(3014): n is a, c, g, or t
  misc_feature (3025)..(3027): n is a, c, g, or t
  misc_feature (3029)..(3029): n is a, c, g, or t
  misc_feature (3040)..(3042): n is a, c, g, or t
  misc_feature (3045)..(3045): n is a, c, g, or t
  misc_feature (3047)..(3050): n is a, c, g, or t
  misc_feature (3053)..(3053): n is a, c, g, or t
  misc_feature (3057)..(3057): n is a, c, g, or t
  misc_feature (3059)..(3059): n is a, c, g, or t
  misc_feature (3063)..(3063): n is a, c, g, or t
  misc_feature (3065)..(3065): n is a, c, g, or t
  misc_feature (3068)..(3069): n is a, c, g, or t
  misc_feature (3071)..(3071): n is a, c, g, or t
  misc_feature (3074)..(3074): n is a, c, g, or t
  misc_feature (3077)..(3078): n is a, c, g, or t
  misc_feature (3080)..(3081): n is a, c, g, or t
  misc_feature (3084)..(3084): n is a, c, g, or t
  misc_feature (3095)..(3095): n is a, c, g, or t
  misc_feature (3099)..(3100): n is a, c, g, or t
  misc_feature (3102)..(3102): n is a, c, g, or t
  misc_feature (3104)..(3104): n is a, c, g, or t
  misc_feature (3107)..(3107): n is a, c, g, or t
  misc_feature (3117)..(3117): n is a, c, g, or t
  misc_feature (3119)..(3119): n is a, c, g, or t
  misc_feature (3121)..(3125): n is a, c, g, or t
  misc_feature (3127)..(3128): n is a, c, g, or t
  misc_feature (3131)..(3133): n is a, c, g, or t
  misc_feature (3135)..(3136): n is a, c, g, or t
  misc_feature (3138)..(3140): n is a, c, g, or t
  misc_feature (3144)..(3146): n is a, c, g, or t
  misc_feature (3148)..(3153): n is a, c, g, or t
  misc_feature (3155)..(3156): n is a, c, g, or t
  misc_feature (3165)..(3168): n is a, c, g, or t
  misc_feature (3171)..(3174): n is a, c, g, or t
  misc_feature (3185)..(3185): n is a, c, g, or t
  misc_feature (3188)..(3191): n is a, c, g, or t
  misc_feature (3194)..(3194): n is a, c, g, or t
  misc_feature (3196)..(3196): n is a, c, g, or t
  misc_feature (3198)..(3203): n is a, c, g, or t
  misc_feature (3209)..(3209): n is a, c, g, or t
  misc_feature (3215)..(3215): n is a, c, g, or t
  misc_feature (3217)..(3218): n is a, c, g, or t
  misc_feature (3224)..(3225): n is a, c, g, or t
  misc_feature (3227)..(3233): n is a, c, g, or t
  misc_feature (3236)..(3236): n is a, c, g, or t
  misc_feature (3239)..(3242): n is a, c, g, or t
  misc_feature (3252)..(3254): n is a, c, g, or t
  misc_feature (3256)..(3261): n is a, c, g, or t
  misc_feature (3263)..(3264): n is a, c, g, or t
  misc_feature (3266)..(3267): n is a, c, g, or t
  misc_feature (3269)..(3270): n is a, c, g, or t
  misc_feature (3272)..(3272): n is a, c, g, or t
  misc_feature (3275)..(3275): n is a, c, g, or t
  misc_feature (3277)..(3279): n is a, c, g, or t
  misc_feature (3284)..(3284): n is a, c, g, or t
  misc_feature (3287)..(3287): n is a, c, g, or t
  misc_feature (3290)..(3291): n is a, c, g, or t
  misc_feature (3297)..(3302): n is a, c, g, or t
  misc_feature (3311)..(3312): n is a, c, g, or t
  misc_feature (3314)..(3315): n is a, c, g, or t
  misc_feature (3317)..(3321): n is a, c, g, or t
  misc_feature (3323)..(3326): n is a, c, g, or t
  misc_feature (3330)..(3330): n is a, c, g, or t
  misc_feature (3333)..(3335): n is a, c, g, or t
  misc_feature (3339)..(3339): n is a, c, g, or t
  misc_feature (3341)..(3341): n is a, c, g, or t
  misc_feature (3345)..(3354): n is a, c, g, or t
  misc_feature (3358)..(3360): n is a, c, g, or t
  misc_feature (3365)..(3365): n is a, c, g, or t
  misc_feature (3368)..(3369): n is a, c, g, or t
  misc_feature (3372)..(3374): n is a, c, g, or t
  misc_feature (3379)..(3380): n is a, c, g, or t
  misc_feature (3389)..(3392): n is a, c, g, or t
  misc_feature (3395)..(3396): n is a, c, g, or t
  misc_feature (3398)..(3398): n is a, c, g, or t
  misc_feature (3401)..(3402): n is a, c, g, or t
  misc_feature (3404)..(3404): n is a, c, g, or t
  misc_feature (3407)..(3410): n is a, c, g, or t
  misc_feature (3414)..(3414): n is a, c, g, or t
  misc_feature (3423)..(3423): n is a, c, g, or t
  misc_feature (3425)..(3425): n is a, c, g, or t
  misc_feature (3428)..(3428): n is a, c, g, or t
  misc_feature (3432)..(3432): n is a, c, g, or t
  misc_feature (3434)..(3434): n is a, c, g, or t
  misc_feature (3440)..(3440): n is a, c, g, or t
  misc_feature (3443)..(3443): n is a, c, g, or t
  misc_feature (3454)..(3455): n is a, c, g, or t
  misc_feature (3465)..(3466): n is a, c, g, or t
  misc_feature (3469)..(3472): n is a, c, g, or t
  misc_feature (3477)..(3478): n is a, c, g, or t
  misc_feature (3485)..(3485): n is a, c, g, or t
  misc_feature (3489)..(3489): n is a, c, g, or t
  misc_feature (3491)..(3491): n is a, c, g, or t
  misc_feature (3494)..(3494): n is a, c, g, or t
  misc_feature (3497)..(3497): n is a, c, g, or t
  misc_feature (3503)..(3503): n is a, c, g, or t
  misc_feature (3509)..(3509): n is a, c, g, or t
  misc_feature (3514)..(3514): n is a, c, g, or t
  misc_feature (3521)..(3521): n is a, c, g, or t
  misc_feature (3528)..(3528): n is a, c, g, or t
  misc_feature (3533)..(3535): n is a, c, g, or t
  misc_feature (3539)..(3539): n is a, c, g, or t
  misc_feature (3542)..(3544): n is a, c, g, or t
  misc_feature (3548)..(3548): n is a, c, g, or t
  misc_feature (3551)..(3552): n is a, c, g, or t
  misc_feature (3554)..(3554): n is a, c, g, or t
  misc_feature (3557)..(3557): n is a, c, g, or t
  misc_feature (3566)..(3566): n is a, c, g, or t
  misc_feature (3569)..(3570): n is a, c, g, or t
  misc_feature (3575)..(3575): n is a, c, g, or t
  misc_feature (3578)..(3580): n is a, c, g, or t
  misc_feature (3584)..(3584): n is a, c, g, or t
  misc_feature (3590)..(3592): n is a, c, g, or t
  misc_feature (3594)..(3595): n is a, c, g, or t
  misc_feature (3599)..(3600): n is a, c, g, or t
  misc_feature (3602)..(3604): n is a, c, g, or t
  misc_feature (3608)..(3609): n is a, c, g, or t
  misc_feature (3611)..(3611): n is a, c, g, or t
  misc_feature (3613)..(3617): n is a, c, g, or t
  misc_feature (3620)..(3623): n is a, c, g, or t
  misc_feature (3629)..(3631): n is a, c, g, or t
  misc_feature (3635)..(3635): n is a, c, g, or t
  misc_feature (3638)..(3638): n is a, c, g, or t
  misc_feature (3643)..(3643): n is a, c, g, or t
  misc_feature (3658)..(3658): n is a, c, g, or t
  misc_feature (3660)..(3664): n is a, c, g, or t
  misc_feature (3666)..(3668): n is a, c, g, or t
  misc_feature (3672)..(3675): n is a, c, g, or t
  misc_feature (3679)..(3680): n is a, c, g, or t
  misc_feature (3683)..(3685): n is a, c, g, or t
  misc_feature (3689)..(3692): n is a, c, g, or t
  misc_feature (3695)..(3696): n is a, c, g, or t
  misc_feature (3698)..(3701): n is a, c, g, or t
  misc_feature (3705)..(3707): n is a, c, g, or t
  misc_feature (3710)..(3711): n is a, c, g, or t
  misc_feature (3713)..(3716): n is a, c, g, or t
  misc_feature (3722)..(3722): n is a, c, g, or t
  misc_feature (3724)..(3725): n is a, c, g, or t
  misc_feature (3737)..(3737): n is a, c, g, or t
  misc_feature (3741)..(3741): n is a, c, g, or t
  misc_feature (3743)..(3743): n is a, c, g, or t
  misc_feature (3746)..(3746): n is a, c, g, or t
  misc_feature (3748)..(3749): n is a, c, g, or t
  misc_feature (3753)..(3753): n is a, c, g, or t
  misc_feature (3756)..(3756): n is a, c, g, or t
  misc_feature (3758)..(3758): n is a, c, g, or t
  misc_feature (3760)..(3761): n is a, c, g, or t
  misc_feature (3764)..(3766): n is a, c, g, or t
  misc_feature (3768)..(3769): n is a, c, g, or t
  misc_feature (3771)..(3773): n is a, c, g, or t
  misc_feature (3778)..(3778): n is a, c, g, or t
  misc_feature (3780)..(3782): n is a, c, g, or t
  misc_feature (3784)..(3787): n is a, c, g, or t
  misc_feature (3791)..(3792): n is a, c, g, or t
  misc_feature (3794)..(3795): n is a, c, g, or t
  misc_feature (3800)..(3802): n is a, c, g, or t
  misc_feature (3804)..(3806): n is a, c, g, or t
  misc_feature (3812)..(3812): n is a, c, g, or t
  misc_feature (3815)..(3816): n is a, c, g, or t
  misc_feature (3819)..(3821): n is a, c, g, or t
  misc_feature (3823)..(3824): n is a, c, g, or t
  misc_feature (3828)..(3828): n is a, c, g, or t
  misc_feature (3830)..(3830): n is a, c, g, or t
  misc_feature (3837)..(3837): n is a, c, g, or t
  misc_feature (3839)..(3839): n is a, c, g, or t
  misc_feature (3842)..(3842): n is a, c, g, or t
  misc_feature (3845)..(3845): n is a, c, g, or t
  misc_feature (3852)..(3852): n is a, c, g, or t
  misc_feature (3854)..(3854): n is a, c, g, or t
  misc_feature (3860)..(3860): n is a, c, g, or t
  misc_feature (3869)..(3869): n is a, c, g, or t
  misc_feature (3874)..(3874): n is a, c, g, or t
  misc_feature (3879)..(3888): n is a, c, g, or t
  misc_feature (3890)..(3890): n is a, c, g, or t
  misc_feature (3893)..(3893): n is a, c, g, or t
  misc_feature (3896)..(3897): n is a, c, g, or t
  misc_feature (3899)..(3901): n is a, c, g, or t
  misc_feature (3903)..(3903): n is a, c, g, or t
  misc_feature (3906)..(3906): n is a, c, g, or t
  misc_feature (3909)..(3909): n is a, c, g, or t
  misc_feature (3911)..(3912): n is a, c, g, or t
  misc_feature (3914)..(3915): n is a, c, g, or t
  misc_feature (3917)..(3917): n is a, c, g, or t
  misc_feature (3920)..(3923): n is a, c, g, or t
  misc_feature (3929)..(3930): n is a, c, g, or t
  misc_feature (3935)..(3939): n is a, c, g, or t
  misc_feature (3944)..(3944): n is a, c, g, or t
  misc_feature (3950)..(3950): n is a, c, g, or t
  misc_feature (3953)..(3953): n is a, c, g, or t
  misc_feature (3959)..(3959): n is a, c, g, or t
  misc_feature (3970)..(3970): n is a, c, g, or t
  misc_feature (3978)..(3978): n is a, c, g, or t
  misc_feature (3980)..(3980): n is a, c, g, or t
  misc_feature (3983)..(3984): n is a, c, g, or t
  misc_feature (3986)..(3986): n is a, c, g, or t
  misc_feature (3993)..(3994): n is a, c, g, or t
  misc_feature (3997)..(3998): n is a, c, g, or t
  misc_feature (4025)..(4029): n is a, c, g, or t
  misc_feature (4034)..(4034): n is a, c, g, or t
  misc_feature (4036)..(4038): n is a, c, g, or t
  misc_feature (4040)..(4040): n is a, c, g, or t
  misc_feature (4043)..(4043): n is a, c, g, or t
  misc_feature (4046)..(4047): n is a, c, g, or t
  misc_feature (4049)..(4049): n is a, c, g, or t
  misc_feature (4051)..(4057): n is a, c, g, or t
  misc_feature (4060)..(4060): n is a, c, g, or t
  misc_feature (4067)..(4067): n is a, c, g, or t
  misc_feature (4096)..(4096): n is a, c, g, or t
  misc_feature (4099)..(4100): n is a, c, g, or t
  misc_feature (4107)..(4108): n is a, c, g, or t
  misc_feature (4110)..(4110): n is a, c, g, or t
  misc_feature (4112)..(4113): n is a, c, g, or t
  misc_feature (4115)..(4120): n is a, c, g, or t
  misc_feature (4122)..(4122): n is a, c, g, or t
  misc_feature (4124)..(4130): n is a, c, g, or t
  misc_feature (4133)..(4134): n is a, c, g, or t
  misc_feature (4136)..(4137): n is a, c, g, or t
  misc_feature (4139)..(4142): n is a, c, g, or t
  misc_feature (4144)..(4145): n is a, c, g, or t
  misc_feature (4147)..(4154): n is a, c, g, or t
  misc_feature (4157)..(4164): n is a, c, g, or t
  misc_feature (4167)..(4169): n is a, c, g, or t
  misc_feature (4171)..(4172): n is a, c, g, or t
  misc_feature (4175)..(4177): n is a, c, g, or t
  misc_feature (4244)..(4245): n is a, c, g, or t
  misc_feature (4247)..(4249): n is a, c, g, or t
  misc_feature (4251)..(4254): n is a, c, g, or t
  misc_feature (4258)..(4261): n is a, c, g, or t
  misc_feature (4265)..(4265): n is a, c, g, or t
  misc_feature (4269)..(4278): n is a, c, g, or t
  misc_feature (4280)..(4280): n is a, c, g, or t
  misc_feature (4289)..(4290): n is a, c, g, or t
  misc_feature (4294)..(4296): n is a, c, g, or t
  misc_feature (4298)..(4298): n is a, c, g, or t
  misc_feature (4302)..(4306): n is a, c, g, or t
  misc_feature (4308)..(4313): n is a, c, g, or t
  misc_feature (4315)..(4318): n is a, c, g, or t
  misc_feature (4320)..(4322): n is a, c, g, or t
  misc_feature (4324)..(4325): n is a, c, g, or t
  misc_feature (4329)..(4329): n is a, c, g, or t
  misc_feature (4334)..(4334): n is a, c, g, or t
  misc_feature (4336)..(4336): n is a, c, g, or t
  misc_feature (4339)..(4340): n is a, c, g, or t
  misc_feature (4351)..(4352): n is a, c, g, or t
  misc_feature (4357)..(4362): n is a, c, g, or t
  misc_feature (4364)..(4364): n is a, c, g, or t
  misc_feature (4370)..(4370): n is a, c, g, or t
  misc_feature (4372)..(4372): n is a, c, g, or t
  misc_feature (4374)..(4378): n is a, c, g, or t
  misc_feature (4382)..(4382): n is a, c, g, or t
  misc_feature (4410)..(4415): n is a, c, g, or t
  misc_feature (4420)..(4420): n is a, c, g, or t
  misc_feature (4422)..(4422): n is a, c, g, or t
  misc_feature (4424)..(4428): n is a, c, g, or t
  misc_feature (4430)..(4432): n is a, c, g, or t
  misc_feature (4436)..(4439): n is a, c, g, or t
  misc_feature (4442)..(4442): n is a, c, g, or t
  misc_feature (4503)..(4503): n is a, c, g, or t
  misc_feature (4505)..(4506): n is a, c, g, or t
  misc_feature (4508)..(4510): n is a, c, g, or t
  misc_feature (4514)..(4515): n is a, c, g, or t
  misc_feature (4521)..(4521): n is a, c, g, or t
  misc_feature (4523)..(4524): n is a, c, g, or t
  misc_feature (4528)..(4528): n is a, c, g, or t
  misc_feature (4533)..(4538): n is a, c, g, or t
  misc_feature (4544)..(4544): n is a, c, g, or t
  misc_feature (4549)..(4552): n is a, c, g, or t
  misc_feature (4556)..(4557): n is a, c, g, or t
  misc_feature (4559)..(4559): n is a, c, g, or t
  misc_feature (4581)..(4583): n is a, c, g, or t
  misc_feature (4587)..(4587): n is a, c, g, or t
  misc_feature (4589)..(4590): n is a, c, g, or t
  misc_feature (4594)..(4594): n is a, c, g, or t
  misc_feature (4596)..(4596): n is a, c, g, or t
  misc_feature (4601)..(4601): n is a, c, g, or t
  misc_feature (4604)..(4605): n is a, c, g, or t
  misc_feature (4607)..(4609): n is a, c, g, or t
  misc_feature (4611)..(4614): n is a, c, g, or t
  misc_feature (4616)..(4616): n is a, c, g, or t
  misc_feature (4619)..(4620): n is a, c, g, or t
  misc_feature (4622)..(4622): n is a, c, g, or t
  misc_feature (4645)..(4645): n is a, c, g, or t
  misc_feature (4650)..(4650): n is a, c, g, or t
  misc_feature (4653)..(4655): n is a, c, g, or t
  misc_feature (4657)..(4658): n is a, c, g, or t
  misc_feature (4660)..(4661): n is a, c, g, or t
  misc_feature (4663)..(4663): n is a, c, g, or t
  misc_feature (4665)..(4665): n is a, c, g, or t
  misc_feature (4672)..(4672): n is a, c, g, or t
  misc_feature (4674)..(4674): n is a, c, g, or t
  misc_feature (4676)..(4680): n is a, c, g, or t
  misc_feature (4682)..(4683): n is a, c, g, or t
  misc_feature (4685)..(4686): n is a, c, g, or t
  misc_feature (4689)..(4690): n is a, c, g, or t
  misc_feature (4694)..(4698): n is a, c, g, or t
  misc_feature (4700)..(4700): n is a, c, g, or t
  misc_feature (4702)..(4702): n is a, c, g, or t
  misc_feature (4706)..(4706): n is a, c, g, or t
  misc_feature (4709)..(4709): n is a, c, g, or t
  misc_feature (4712)..(4713): n is a, c, g, or t
  misc_feature (4715)..(4715): n is a, c, g, or t
  misc_feature (4757)..(4757): n is a, c, g, or t
  misc_feature (4759)..(4761): n is a, c, g, or t
  misc_feature (4764)..(4764): n is a, c, g, or t
  misc_feature (4766)..(4766): n is a, c, g, or t
  misc_feature (4768)..(4770): n is a, c, g, or t
  misc_feature (4776)..(4778): n is a, c, g, or t
  misc_feature (4783)..(4785): n is a, c, g, or t
  misc_feature (4787)..(4787): n is a, c, g, or t
  misc_feature (4789)..(4793): n is a, c, g, or t
  misc_feature (4821)..(4828): n is a, c, g, or t
  misc_feature (4830)..(4833): n is a, c, g, or t
  misc_feature (4835)..(4835): n is a, c, g, or t
  misc_feature (4837)..(4839): n is a, c, g, or t
  misc_feature (4841)..(4843): n is a, c, g, or t
  misc_feature (4845)..(4848): n is a, c, g, or t
  misc_feature (4850)..(4850): n is a, c, g, or t
  misc_feature (4853)..(4854): n is a, c, g, or t
  misc_feature (4856)..(4856): n is a, c, g, or t
  misc_feature (4860)..(4860): n is a, c, g, or t
  misc_feature (4862)..(4866): n is a, c, g, or t
  misc_feature (4868)..(4871): n is a, c, g, or t
  misc_feature (4873)..(4873): n is a, c, g, or t
  misc_feature (4877)..(4883): n is a, c, g, or t
  misc_feature (4885)..(4885): n is a, c, g, or t
  misc_feature (4887)..(4889): n is a, c, g, or t
  misc_feature (4892)..(4892): n is a, c, g, or t
  misc_feature (4895)..(4899): n is a, c, g, or t
  misc_feature (4901)..(4901): n is a, c, g, or t
  misc_feature (4903)..(4905): n is a, c, g, or t
  misc_feature (4909)..(4909): n is a, c, g, or t
  misc_feature (4911)..(4911): n is a, c, g, or t
  misc_feature (4914)..(4914): n is a, c, g, or t
  misc_feature (4918)..(4918): n is a, c, g, or t
  misc_feature (4922)..(4922): n is a, c, g, or t
  misc_feature (4925)..(4925): n is a, c, g, or t
  misc_feature (4928)..(4935): n is a, c, g, or t
  misc_feature (4940)..(4943): n is a, c, g, or t
  misc_feature (4947)..(4947): n is a, c, g, or t
  misc_feature (4949)..(4949): n is a, c, g, or t
  misc_feature (4952)..(4954): n is a, c, g, or t
  misc_feature (4956)..(4957): n is a, c, g, or t
  misc_feature (4959)..(4960): n is a, c, g, or t
  misc_feature (4962)..(4962): n is a, c, g, or t
  misc_feature (4964)..(4969): n is a, c, g, or t
  misc_feature (4971)..(4980): n is a, c, g, or t
  misc_feature (4982)..(4983): n is a, c, g, or t
  misc_feature (4985)..(4985): n is a, c, g, or t
  misc_feature (4987)..(4989): n is a, c, g, or t
  misc_feature (4991)..(4993): n is a, c, g, or t
  misc_feature (4995)..(4995): n is a, c, g, or t
  misc_feature (4997)..(5001): n is a, c, g, or t
  misc_feature (5006)..(5007): n is a, c, g, or t
  misc_feature (5009)..(5009): n is a, c, g, or t
  misc_feature (5012)..(5013): n is a, c, g, or t
  misc_feature (5018)..(5018): n is a, c, g, or t
  misc_feature (5025)..(5032): n is a, c, g, or t
  misc_feature (5034)..(5036): n is a, c, g, or t
  misc_feature (5039)..(5039): n is a, c, g, or t
  misc_feature (5041)..(5042): n is a, c, g, or t
  misc_feature (5045)..(5047): n is a, c, g, or t
  misc_feature (5049)..(5051): n is a, c, g, or t
  misc_feature (5053)..(5055): n is a, c, g, or t
  misc_feature (5057)..(5058): n is a, c, g, or t
  misc_feature (5060)..(5061): n is a, c, g, or t
  misc_feature (5066)..(5066): n is a, c, g, or t
  misc_feature (5069)..(5069): n is a, c, g, or t
  misc_feature (5082)..(5085): n is a, c, g, or t
  misc_feature (5089)..(5090): n is a, c, g, or t
  misc_feature (5094)..(5094): n is a, c, g, or t
  misc_feature (5096)..(5096): n is a, c, g, or t
  misc_feature (5099)..(5099): n is a, c, g, or t
  misc_feature (5102)..(5102): n is a, c, g, or t
  misc_feature (5106)..(5107): n is a, c, g, or t
  misc_feature (5113)..(5113): n is a, c, g, or t
  misc_feature (5115)..(5115): n is a, c, g, or t
  misc_feature (5117)..(5117): n is a, c, g, or t
  misc_feature (5125)..(5126): n is a, c, g, or t
  misc_feature (5129)..(5130): n is a, c, g, or t
  misc_feature (5132)..(5132): n is a, c, g, or t
  misc_feature (5136)..(5141): n is a, c, g, or t
  misc_feature (5143)..(5145): n is a, c, g, or t
  misc_feature (5147)..(5148): n is a, c, g, or t
  misc_feature (5151)..(5152): n is a, c, g, or t
  misc_feature (5156)..(5156): n is a, c, g, or t
  misc_feature (5159)..(5162): n is a, c, g, or t
  misc_feature (5165)..(5166): n is a, c, g, or t
  misc_feature (5171)..(5171): n is a, c, g, or t
  misc_feature (5187)..(5187): n is a, c, g, or t
  misc_feature (5189)..(5189): n is a, c, g, or t
  misc_feature (5193)..(5193): n is a, c, g, or t
  misc_feature (5195)..(5198): n is a, c, g, or t
  misc_feature (5202)..(5206): n is a, c, g, or t
  misc_feature (5208)..(5208): n is a, c, g, or t
  misc_feature (5212)..(5213): n is a, c, g, or t
  misc_feature (5215)..(5216): n is a, c, g, or t
  misc_feature (5219)..(5219): n is a, c, g, or t
  misc_feature (5222)..(5223): n is a, c, g, or t
  misc_feature (5228)..(5229): n is a, c, g, or t
  misc_feature (5231)..(5235): n is a, c, g, or t
  misc_feature (5237)..(5237): n is a, c, g, or t
  misc_feature (5240)..(5243): n is a, c, g, or t
  misc_feature (5245)..(5245): n is a, c, g, or t
  misc_feature (5247)..(5248): n is a, c, g, or t
  misc_feature (5251)..(5251): n is a, c, g, or t
  misc_feature (5262)..(5268): n is a, c, g, or t
  misc_feature (5271)..(5273): n is a, c, g, or t
  misc_feature (5286)..(5286): n is a, c, g, or t
  misc_feature (5288)..(5289): n is a, c, g, or t
  misc_feature (5294)..(5294): n is a, c, g, or t
  misc_feature (5298)..(5298): n is a, c, g, or t
  misc_feature (5300)..(5300): n is a, c, g, or t
  misc_feature (5302)..(5304): n is a, c, g, or t
  misc_feature (5306)..(5306): n is a, c, g, or t
  misc_feature (5308)..(5309): n is a, c, g, or t
  misc_feature (5313)..(5314): n is a, c, g, or t
  misc_feature (5321)..(5322): n is a, c, g, or t
  misc_feature (5324)..(5327): n is a, c, g, or t
  misc_feature (5329)..(5330): n is a, c, g, or t
  misc_feature (5332)..(5333): n is a, c, g, or t
  misc_feature (5335)..(5335): n is a, c, g, or t
  misc_feature (5337)..(5337): n is a, c, g, or t
  misc_feature (5339)..(5339): n is a, c, g, or t
  misc_feature (5342)..(5342): n is a, c, g, or t
  misc_feature (5359)..(5360): n is a, c, g, or t
  misc_feature (5367)..(5368): n is a, c, g, or t
  misc_feature (5371)..(5375): n is a, c, g, or t
  misc_feature (5379)..(5379): n is a, c, g, or t
  misc_feature (5381)..(5385): n is a, c, g, or t
  misc_feature (5389)..(5390): n is a, c, g, or t
  misc_feature (5393)..(5393): n is a, c, g, or t
  misc_feature (5396)..(5396): n is a, c, g, or t
  misc_feature (5399)..(5399): n is a, c, g, or t
  misc_feature (5403)..(5404): n is a, c, g, or t
  misc_feature (5408)..(5410): n is a, c, g, or t
  misc_feature (5412)..(5414): n is a, c, g, or t
  misc_feature (5416)..(5417): n is a, c, g, or t
  misc_feature (5420)..(5423): n is a, c, g, or t
  misc_feature (5425)..(5426): n is a, c, g, or t
  misc_feature (5429)..(5430): n is a, c, g, or t
  misc_feature (5438)..(5438): n is a, c, g, or t
  misc_feature (5446)..(5448): n is a, c, g, or t
  misc_feature (5451)..(5452): n is a, c, g, or t
  misc_feature (5454)..(5454): n is a, c, g, or t
  misc_feature (5456)..(5456): n is a, c, g, or t
  misc_feature (5459)..(5459): n is a, c, g, or t
  misc_feature (5471)..(5471): n is a, c, g, or t
  misc_feature (5474)..(5474): n is a, c, g, or t
  misc_feature (5477)..(5477): n is a, c, g, or t
  misc_feature (5479)..(5486): n is a, c, g, or t
  misc_feature (5507)..(5508): n is a, c, g, or t
  misc_feature (5511)..(5511): n is a, c, g, or t
  misc_feature (5513)..(5513): n is a, c, g, or t
  misc_feature (5516)..(5516): n is a, c, g, or t
  misc_feature (5518)..(5520): n is a, c, g, or t
  misc_feature (5522)..(5522): n is a, c, g, or t
  misc_feature (5525)..(5526): n is a, c, g, or t
  misc_feature (5530)..(5534): n is a, c, g, or t
  misc_feature (5536)..(5537): n is a, c, g, or t
  misc_feature (5540)..(5540): n is a, c, g, or t
  misc_feature (5543)..(5543): n is a, c, g, or t
  misc_feature (5549)..(5549): n is a, c, g, or t
  misc_feature (5551)..(5551): n is a, c, g, or t
  misc_feature (5564)..(5564): n is a, c, g, or t
  misc_feature (5570)..(5571): n is a, c, g, or t
  misc_feature (5573)..(5573): n is a, c, g, or t
  misc_feature (5576)..(5577): n is a, c, g, or t
  misc_feature (5585)..(5585): n is a, c, g, or t
  misc_feature (5588)..(5588): n is a, c, g, or t
  misc_feature (5590)..(5590): n is a, c, g, or t
  misc_feature (5592)..(5592): n is a, c, g, or t
  misc_feature (5594)..(5594): n is a, c, g, or t
  misc_feature (5598)..(5598): n is a, c, g, or t
  misc_feature (5601)..(5602): n is a, c, g, or t
  misc_feature (5608)..(5611): n is a, c, g, or t
  misc_feature (5613)..(5613): n is a, c, g, or t
  misc_feature (5618)..(5618): n is a, c, g, or t
  misc_feature (5621)..(5621): n is a, c, g, or t
  misc_feature (5624)..(5625): n is a, c, g, or t
  misc_feature (5627)..(5628): n is a, c, g, or t
  misc_feature (5630)..(5630): n is a, c, g, or t
  misc_feature (5633)..(5635): n is a, c, g, or t
  misc_feature (5639)..(5639): n is a, c, g, or t
  misc_feature (5642)..(5643): n is a, c, g, or t
  misc_feature (5645)..(5645): n is a, c, g, or t
  misc_feature (5648)..(5648): n is a, c, g, or t
  misc_feature (5651)..(5651): n is a, c, g, or t
  misc_feature (5653)..(5654): n is a, c, g, or t
  misc_feature (5660)..(5660): n is a, c, g, or t
  misc_feature (5664)..(5667): n is a, c, g, or t
  misc_feature (5672)..(5672): n is a, c, g, or t
  misc_feature (5675)..(5676): n is a, c, g, or t
  misc_feature (5678)..(5678): n is a, c, g, or t
  misc_feature (5681)..(5685): n is a, c, g, or t
  misc_feature (5688)..(5691): n is a, c, g, or t
  misc_feature (5693)..(5693): n is a, c, g, or t
  misc_feature (5697)..(5697): n is a, c, g, or t
  misc_feature (5699)..(5700): n is a, c, g, or t
  misc_feature (5703)..(5704): n is a, c, g, or t
  misc_feature (5706)..(5706): n is a, c, g, or t
  misc_feature (5709)..(5709): n is a, c, g, or t
  misc_feature (5711)..(5714): n is a, c, g, or t
  misc_feature (5716)..(5716): n is a, c, g, or t
  misc_feature (5718)..(5718): n is a, c, g, or t
  misc_feature (5724)..(5724): n is a, c, g, or t
  misc_feature (5726)..(5726): n is a, c, g, or t
  misc_feature (5729)..(5729): n is a, c, g, or t
  misc_feature (5732)..(5733): n is a, c, g, or t
  misc_feature (5735)..(5735): n is a, c, g, or t
  misc_feature (5738)..(5738): n is a, c, g, or t
  misc_feature (5745)..(5745): n is a, c, g, or t
  misc_feature (5747)..(5747): n is a, c, g, or t
  misc_feature (5755)..(5755): n is a, c, g, or t
  misc_feature (5757)..(5762): n is a, c, g, or t
  misc_feature (5765)..(5765): n is a, c, g, or t
  misc_feature (5767)..(5768): n is a, c, g, or t
  misc_feature (5789)..(5794): n is a, c, g, or t
  misc_feature (5798)..(5799): n is a, c, g, or t
  misc_feature (5816)..(5816): n is a, c, g, or t
  misc_feature (5823)..(5823): n is a, c, g, or t
  misc_feature (5825)..(5825): n is a, c, g, or t
  misc_feature (5835)..(5838): n is a, c, g, or t
  misc_feature (5840)..(5840): n is a, c, g, or t
  misc_feature (5843)..(5843): n is a, c, g, or t
  misc_feature (5845)..(5846): n is a, c, g, or t
  misc_feature (5852)..(5852): n is a, c, g, or t
  misc_feature (5855)..(5856): n is a, c, g, or t
  misc_feature (5861)..(5861): n is a, c, g, or t
  misc_feature (5867)..(5867): n is a, c, g, or t
  misc_feature (5869)..(5870): n is a, c, g, or t
  misc_feature (5872)..(5872): n is a, c, g, or t
  misc_feature (5874)..(5874): n is a, c, g, or t
  misc_feature (5876)..(5880): n is a, c, g, or t
  misc_feature (5882)..(5882): n is a, c, g, or t
  misc_feature (5888)..(5888): n is a, c, g, or t
  misc_feature (5892)..(5892): n is a, c, g, or t
  misc_feature (5894)..(5895): n is a, c, g, or t
  misc_feature (5897)..(5897): n is a, c, g, or t
  misc_feature (5900)..(5900): n is a, c, g, or t
  misc_feature (5903)..(5903): n is a, c, g, or t
  misc_feature (5906)..(5906): n is a, c, g, or t
  misc_feature (5908)..(5909): n is a, c, g, or t
  misc_feature (5918)..(5918): n is a, c, g, or t
  misc_feature (5921)..(5921): n is a, c, g, or t
  misc_feature (5924)..(5924): n is a, c, g, or t
  misc_feature (5927)..(5927): n is a, c, g, or t
  misc_feature (5930)..(5933): n is a, c, g, or t
  misc_feature (5935)..(5936): n is a, c, g, or t
  misc_feature (5943)..(5943): n is a, c, g, or t
  misc_feature (5945)..(5948): n is a, c, g, or t
  misc_feature (5951)..(5955): n is a, c, g, or t
  misc_feature (5960)..(5960): n is a, c, g, or t
  misc_feature (5964)..(5964): n is a, c, g, or t
  misc_feature (5966)..(5966): n is a, c, g, or t
  misc_feature (5969)..(5972): n is a, c, g, or t
  misc_feature (5975)..(5975): n is a, c, g, or t
  misc_feature (5978)..(5978): n is a, c, g, or t
  misc_feature (5987)..(5987): n is a, c, g, or t
  misc_feature (5990)..(5990): n is a, c, g, or t
  misc_feature (5999)..(5999): n is a, c, g, or t
  misc_feature (6006)..(6006): n is a, c, g, or t
  misc_feature (6011)..(6011): n is a, c, g, or t
  misc_feature (6018)..(6019): n is a, c, g, or t
  misc_feature (6021)..(6021): n is a, c, g, or t
  misc_feature (6023)..(6023): n is a, c, g, or t
  misc_feature (6026)..(6027): n is a, c, g, or t
  misc_feature (6029)..(6030): n is a, c, g, or t
  misc_feature (6032)..(6033): n is a, c, g, or t
  misc_feature (6038)..(6038): n is a, c, g, or t
  misc_feature (6063)..(6063): n is a, c, g, or t
  misc_feature (6065)..(6066): n is a, c, g, or t
  misc_feature (6068)..(6071): n is a, c, g, or t
  misc_feature (6074)..(6076): n is a, c, g, or t
  misc_feature (6083)..(6083): n is a, c, g, or t
  misc_feature (6086)..(6086): n is a, c, g, or t
  misc_feature (6088)..(6089): n is a, c, g, or t
  misc_feature (6092)..(6092): n is a, c, g, or t
  misc_feature (6094)..(6094): n is a, c, g, or t
  misc_feature (6098)..(6098): n is a, c, g, or t
  misc_feature (6116)..(6116): n is a, c, g, or t
  misc_feature (6121)..(6122): n is a, c, g, or t
  misc_feature (6125)..(6125): n is a, c, g, or t
  misc_feature (6131)..(6131): n is a, c, g, or t
  misc_feature (6134)..(6139): n is a, c, g, or t
  misc_feature (6141)..(6143): n is a, c, g, or t
  misc_feature (6149)..(6149): n is a, c, g, or t
  misc_feature (6152)..(6152): n is a, c, g, or t
  misc_feature (6154)..(6155): n is a, c, g, or t
  misc_feature (6157)..(6158): n is a, c, g, or t
  misc_feature (6161)..(6161): n is a, c, g, or t
  misc_feature (6163)..(6165): n is a, c, g, or t
  misc_feature (6167)..(6167): n is a, c, g, or t
  misc_feature (6170)..(6170): n is a, c, g, or t
  misc_feature (6174)..(6176): n is a, c, g, or t
  misc_feature (6179)..(6179): n is a, c, g, or t
  misc_feature (6186)..(6186): n is a, c, g, or t
  misc_feature (6188)..(6189): n is a, c, g, or t
  misc_feature (6191)..(6191): n is a, c, g, or t
  misc_feature (6198)..(6198): n is a, c, g, or t
  misc_feature (6200)..(6201): n is a, c, g, or t
  misc_feature (6203)..(6204): n is a, c, g, or t
  misc_feature (6206)..(6207): n is a, c, g, or t
  misc_feature (6209)..(6210): n is a, c, g, or t
  misc_feature (6213)..(6215): n is a, c, g, or t
  misc_feature (6218)..(6221): n is a, c, g, or t
  misc_feature (6231)..(6232): n is a, c, g, or t
  misc_feature (6236)..(6236): n is a, c, g, or t
  misc_feature (6239)..(6239): n is a, c, g, or t
  misc_feature (6241)..(6242): n is a, c, g, or t
  misc_feature (6245)..(6245): n is a, c, g, or t
  misc_feature (6248)..(6249): n is a, c, g, or t
  misc_feature (6252)..(6260): n is a, c, g, or t
  misc_feature (6264)..(6266): n is a, c, g, or t
  misc_feature (6269)..(6269): n is a, c, g, or t
  misc_feature (6280)..(6280): n is a, c, g, or t
  misc_feature (6282)..(6283): n is a, c, g, or t
  misc_feature (6287)..(6287): n is a, c, g, or t
  misc_feature (6291)..(6291): n is a, c, g, or t
  misc_feature (6293)..(6293): n is a, c, g, or t
  misc_feature (6301)..(6301): n is a, c, g, or t
  misc_feature (6311)..(6311): n is a, c, g, or t
  misc_feature (6318)..(6318): n is a, c, g, or t
  misc_feature (6320)..(6320): n is a, c, g, or t
  misc_feature (6322)..(6323): n is a, c, g, or t
  misc_feature (6326)..(6326): n is a, c, g, or t
  misc_feature (6328)..(6328): n is a, c, g, or t
  misc_feature (6338)..(6338): n is a, c, g, or t
  misc_feature (6341)..(6342): n is a, c, g, or t
  misc_feature (6347)..(6347): n is a, c, g, or t
  misc_feature (6349)..(6357): n is a, c, g, or t
  misc_feature (6359)..(6359): n is a, c, g, or t
  misc_feature (6365)..(6365): n is a, c, g, or t
  misc_feature (6367)..(6367): n is a, c, g, or t
  misc_feature (6369)..(6369): n is a, c, g, or t
  misc_feature (6371)..(6371): n is a, c, g, or t
  misc_feature (6375)..(6375): n is a, c, g, or t
  misc_feature (6377)..(6377): n is a, c, g, or t
  misc_feature (6380)..(6380): n is a, c, g, or t
  misc_feature (6383)..(6383): n is a, c, g, or t
  misc_feature (6386)..(6386): n is a, c, g, or t
  misc_feature (6395)..(6395): n is a, c, g, or t
  misc_feature (6398)..(6398): n is a, c, g, or t
  misc_feature (6404)..(6404): n is a, c, g, or t
  misc_feature (6407)..(6407): n is a, c, g, or t
  misc_feature (6410)..(6411): n is a, c, g, or t
  misc_feature (6413)..(6414): n is a, c, g, or t
  misc_feature (6416)..(6416): n is a, c, g, or t
  misc_feature (6422)..(6422): n is a, c, g, or t
  misc_feature (6425)..(6425): n is a, c, g, or t
  misc_feature (6432)..(6432): n is a, c, g, or t
  misc_feature (6440)..(6441): n is a, c, g, or t
  misc_feature (6443)..(6443): n is a, c, g, or t
  misc_feature (6446)..(6446): n is a, c, g, or t
  misc_feature (6452)..(6453): n is a, c, g, or t
  misc_feature (6455)..(6456): n is a, c, g, or t
  misc_feature (6458)..(6458): n is a, c, g, or t
  misc_feature (6460)..(6462): n is a, c, g, or t
  misc_feature (6464)..(6464): n is a, c, g, or t
  misc_feature (6467)..(6468): n is a, c, g, or t
  misc_feature (6470)..(6470): n is a, c, g, or t
  misc_feature (6473)..(6474): n is a, c, g, or t
  misc_feature (6481)..(6482): n is a, c, g, or t
  misc_feature (6485)..(6489): n is a, c, g, or t
  misc_feature (6491)..(6491): n is a, c, g, or t
  misc_feature (6493)..(6500): n is a, c, g, or t
  misc_feature (6504)..(6506): n is a, c, g, or t
  misc_feature (6509)..(6509): n is a, c, g, or t
  misc_feature (6512)..(6514): n is a, c, g, or t
  misc_feature (6516)..(6518): n is a, c, g, or t
  misc_feature (6520)..(6523): n is a, c, g, or t
  misc_feature (6525)..(6525): n is a, c, g, or t
  misc_feature (6527)..(6527): n is a, c, g, or t
  misc_feature (6530)..(6531): n is a, c, g, or t
  misc_feature (6533)..(6534): n is a, c, g, or t
  misc_feature (6536)..(6539): n is a, c, g, or t
  misc_feature (6544)..(6544): n is a, c, g, or t
  misc_feature (6551)..(6553): n is a, c, g, or t
  misc_feature (6556)..(6557): n is a, c, g, or t
  misc_feature (6559)..(6559): n is a, c, g, or t
  misc_feature (6564)..(6566): n is a, c, g, or t
  misc_feature (6572)..(6573): n is a, c, g, or t
  misc_feature (6575)..(6576): n is a, c, g, or t
  misc_feature (6579)..(6580): n is a, c, g, or t
  misc_feature (6582)..(6582): n is a, c, g, or t
  misc_feature (6585)..(6588): n is a, c, g, or t
  misc_feature (6591)..(6591): n is a, c, g, or t
  misc_feature (6593)..(6593): n is a, c, g, or t
  misc_feature (6595)..(6597): n is a, c, g, or t
  misc_feature (6599)..(6600): n is a, c, g, or t
  misc_feature (6603)..(6603): n is a, c, g, or t
  misc_feature (6607)..(6611): n is a, c, g, or t
  misc_feature (6617)..(6618): n is a, c, g, or t
  misc_feature (6620)..(6621): n is a, c, g, or t
  misc_feature (6623)..(6624): n is a, c, g, or t
  misc_feature (6626)..(6626): n is a, c, g, or t
  misc_feature (6629)..(6633): n is a, c, g, or t
  misc_feature (6635)..(6636): n is a, c, g, or t
  misc_feature (6638)..(6641): n is a, c, g, or t
  misc_feature (6643)..(6644): n is a, c, g, or t
  misc_feature (6650)..(6651): n is a, c, g, or t
  misc_feature (6655)..(6655): n is a, c, g, or t
  misc_feature (6659)..(6659): n is a, c, g, or t
  misc_feature (6662)..(6662): n is a, c, g, or t
  misc_feature (6667)..(6669): n is a, c, g, or t
  misc_feature (6674)..(6674): n is a, c, g, or t
  misc_feature (6676)..(6678): n is a, c, g, or t
  misc_feature (6680)..(6680): n is a, c, g, or t
  misc_feature (6682)..(6683): n is a, c, g, or t
  misc_feature (6687)..(6689): n is a, c, g, or t
  misc_feature (6691)..(6691): n is a, c, g, or t
  misc_feature (6693)..(6695): n is a, c, g, or t
  misc_feature (6698)..(6698): n is a, c, g, or t
  misc_feature (6701)..(6701): n is a, c, g, or t
  misc_feature (6703)..(6705): n is a, c, g, or t
  misc_feature (6711)..(6712): n is a, c, g, or t
  misc_feature (6716)..(6720): n is a, c, g, or t
  misc_feature (6722)..(6725): n is a, c, g, or t
  misc_feature (6727)..(6729): n is a, c, g, or t
  misc_feature (6731)..(6734): n is a, c, g, or t
  misc_feature (6737)..(6737): n is a, c, g, or t
  misc_feature (6739)..(6743): n is a, c, g, or t
  misc_feature (6747)..(6747): n is a, c, g, or t
  misc_feature (6749)..(6750): n is a, c, g, or t
  misc_feature (6752)..(6753): n is a, c, g, or t
  misc_feature (6756)..(6756): n is a, c, g, or t
  misc_feature (6758)..(6758): n is a, c, g, or t
  misc_feature (6764)..(6766): n is a, c, g, or t
  misc_feature (6770)..(6771): n is a, c, g, or t
  misc_feature (6773)..(6773): n is a, c, g, or t
  misc_feature (6776)..(6776): n is a, c, g, or t
  misc_feature (6778)..(6782): n is a, c, g, or t
  misc_feature (6785)..(6786): n is a, c, g, or t
  misc_feature (6792)..(6793): n is a, c, g, or t
  misc_feature (6795)..(6795): n is a, c, g, or t
  misc_feature (6798)..(6798): n is a, c, g, or t
  misc_feature (6802)..(6803): n is a, c, g, or t
  misc_feature (6805)..(6805): n is a, c, g, or t
  misc_feature (6807)..(6807): n is a, c, g, or t
  misc_feature (6809)..(6809): n is a, c, g, or t
  misc_feature (6811)..(6813): n is a, c, g, or t
  misc_feature (6817)..(6818): n is a, c, g, or t
  misc_feature (6821)..(6828): n is a, c, g, or t
  misc_feature (6830)..(6830): n is a, c, g, or t
  misc_feature (6832)..(6836): n is a, c, g, or t
  misc_feature (6839)..(6844): n is a, c, g, or t
  misc_feature (6846)..(6851): n is a, c, g, or t
  misc_feature (6853)..(6854): n is a, c, g, or t
  misc_feature (6856)..(6856): n is a, c, g, or t
  misc_feature (6858)..(6863): n is a, c, g, or t
  misc_feature (6869)..(6872): n is a, c, g, or t
  misc_feature (6879)..(6879): n is a, c, g, or t
  misc_feature (6881)..(6881): n is a, c, g, or t
  misc_feature (6884)..(6885): n is a, c, g, or t
  misc_feature (6887)..(6889): n is a, c, g, or t
  misc_feature (6896)..(6896): n is a, c, g, or t
  misc_feature (6899)..(6902): n is a, c, g, or t
  misc_feature (6904)..(6905): n is a, c, g, or t
  misc_feature (6908)..(6909): n is a, c, g, or t
  misc_feature (6911)..(6911): n is a, c, g, or t
  misc_feature (6913)..(6915): n is a, c, g, or t
  misc_feature (6917)..(6918): n is a, c, g, or t
  misc_feature (6920)..(6921): n is a, c, g, or t
  misc_feature (6923)..(6923): n is a, c, g, or t
  misc_feature (6925)..(6925): n is a, c, g, or t
  misc_feature (6929)..(6930): n is a, c, g, or t
  misc_feature (6932)..(6933): n is a, c, g, or t
  misc_feature (6935)..(6935): n is a, c, g, or t
  misc_feature (6938)..(6940): n is a, c, g, or t
  misc_feature (6945)..(6947): n is a, c, g, or t
  misc_feature (6949)..(6954): n is a, c, g, or t
  misc_feature (6959)..(6961): n is a, c, g, or t
  misc_feature (6964)..(6969): n is a, c, g, or t
  misc_feature (6973)..(6975): n is a, c, g, or t
  misc_feature (6983)..(6983): n is a, c, g, or t
  misc_feature (6987)..(6990): n is a, c, g, or t
  misc_feature (6992)..(6992): n is a, c, g, or t
  misc_feature (6995)..(6995): n is a, c, g, or t
  misc_feature (7005)..(7013): n is a, c, g, or t
  misc_feature (7016)..(7016): n is a, c, g, or t
  misc_feature (7019)..(7019): n is a, c, g, or t
  misc_feature (7022)..(7024): n is a, c, g, or t
  misc_feature (7026)..(7029): n is a, c, g, or t
  misc_feature (7032)..(7032): n is a, c, g, or t
  misc_feature (7034)..(7034): n is a, c, g, or t
  misc_feature (7037)..(7042): n is a, c, g, or t
  misc_feature (7044)..(7044): n is a, c, g, or t
  misc_feature (7046)..(7051): n is a, c, g, or t
  misc_feature (7053)..(7055): n is a, c, g, or t
  misc_feature (7058)..(7068): n is a, c, g, or t
  misc_feature (7073)..(7081): n is a, c, g, or t
  misc_feature (7083)..(7083): n is a, c, g, or t
  misc_feature (7086)..(7090): n is a, c, g, or t
  misc_feature (7093)..(7095): n is a, c, g, or t
  misc_feature (7098)..(7099): n is a, c, g, or t
  misc_feature (7104)..(7106): n is a, c, g, or t
  misc_feature (7110)..(7110): n is a, c, g, or t
  misc_feature (7112)..(7113): n is a, c, g, or t
  misc_feature (7115)..(7117): n is a, c, g, or t
  misc_feature (7119)..(7121): n is a, c, g, or t
  misc_feature (7124)..(7124): n is a, c, g, or t
  misc_feature (7129)..(7130): n is a, c, g, or t
  misc_feature (7134)..(7134): n is a, c, g, or t
  misc_feature (7136)..(7136): n is a, c, g, or t
  misc_feature (7138)..(7138): n is a, c, g, or t
  misc_feature (7143)..(7143): n is a, c, g, or t
  misc_feature (7149)..(7149): n is a, c, g, or t
  misc_feature (7152)..(7152): n is a, c, g, or t
  misc_feature (7154)..(7156): n is a, c, g, or t
  misc_feature (7158)..(7160): n is a, c, g, or t
  misc_feature (7162)..(7162): n is a, c, g, or t
  misc_feature (7166)..(7166): n is a, c, g, or t
  misc_feature (7170)..(7170): n is a, c, g, or t
  misc_feature (7172)..(7172): n is a, c, g, or t
  misc_feature (7183)..(7184): n is a, c, g, or t
  misc_feature (7186)..(7187): n is a, c, g, or t
  misc_feature (7193)..(7196): n is a, c, g, or t
  misc_feature (7199)..(7202): n is a, c, g, or t
  misc_feature (7205)..(7206): n is a, c, g, or t
  misc_feature (7208)..(7208): n is a, c, g, or t
  misc_feature (7212)..(7212): n is a, c, g, or t
  misc_feature (7218)..(7218): n is a, c, g, or t
  misc_feature (7220)..(7220): n is a, c, g, or t
  misc_feature (7223)..(7223): n is a, c, g, or t
  misc_feature (7229)..(7230): n is a, c, g, or t
  misc_feature (7232)..(7232): n is a, c, g, or t
  misc_feature (7235)..(7235): n is a, c, g, or t
  misc_feature (7238)..(7238): n is a, c, g, or t
  misc_feature (7240)..(7242): n is a, c, g, or t
  misc_feature (7244)..(7246): n is a, c, g, or t
  misc_feature (7248)..(7249): n is a, c, g, or t
  misc_feature (7251)..(7252): n is a, c, g, or t
  misc_feature (7254)..(7254): n is a, c, g, or t
  misc_feature (7256)..(7259): n is a, c, g, or t
  misc_feature (7261)..(7266): n is a, c, g, or t
  misc_feature (7268)..(7268): n is a, c, g, or t
  misc_feature (7274)..(7274): n is a, c, g, or t
  misc_feature (7276)..(7277): n is a, c, g, or t
  misc_feature (7282)..(7282): n is a, c, g, or t
  misc_feature (7286)..(7286): n is a, c, g, or t
  misc_feature (7288)..(7290): n is a, c, g, or t
  misc_feature (7293)..(7293): n is a, c, g, or t
  misc_feature (7296)..(7296): n is a, c, g, or t
  misc_feature (7298)..(7298): n is a, c, g, or t
  misc_feature (7302)..(7304): n is a, c, g, or t
  misc_feature (7308)..(7311): n is a, c, g, or t
  misc_feature (7313)..(7313): n is a, c, g, or t
  misc_feature (7316)..(7317): n is a, c, g, or t
  misc_feature (7319)..(7319): n is a, c, g, or t
  misc_feature (7322)..(7322): n is a, c, g, or t
  misc_feature (7327)..(7328): n is a, c, g, or t
  misc_feature (7331)..(7331): n is a, c, g, or t
  misc_feature (7337)..(7338): n is a, c, g, or t
  misc_feature (7343)..(7343): n is a, c, g, or t
  misc_feature (7355)..(7355): n is a, c, g, or t
  misc_feature (7358)..(7358): n is a, c, g, or t
  misc_feature (7361)..(7361): n is a, c, g, or t
  misc_feature (7367)..(7367): n is a, c, g, or t
  misc_feature (7370)..(7370): n is a, c, g, or t
  misc_feature (7373)..(7374): n is a, c, g, or t
  misc_feature (7376)..(7377): n is a, c, g, or t
  misc_feature (7379)..(7379): n is a, c, g, or t
  misc_feature (7385)..(7385): n is a, c, g, or t
  misc_feature (7391)..(7391): n is a, c, g, or t
  misc_feature (7395)..(7396): n is a, c, g, or t
  misc_feature (7400)..(7400): n is a, c, g, or t
  misc_feature (7402)..(7406): n is a, c, g, or t
  misc_feature (7409)..(7409): n is a, c, g, or t
  misc_feature (7415)..(7415): n is a, c, g, or t
  misc_feature (7419)..(7419): n is a, c, g, or t
  misc_feature (7421)..(7421): n is a, c, g, or t
  misc_feature (7424)..(7425): n is a, c, g, or t
  misc_feature (7427)..(7427): n is a, c, g, or t
  misc_feature (7431)..(7431): n is a, c, g, or t
  misc_feature (7433)..(7434): n is a, c, g, or t
  misc_feature (7436)..(7436): n is a, c, g, or t
  misc_feature (7442)..(7442): n is a, c, g, or t
  misc_feature (7445)..(7445): n is a, c, g, or t
  misc_feature (7448)..(7448): n is a, c, g, or t
  misc_feature (7451)..(7452): n is a, c, g, or t
  misc_feature (7454)..(7454): n is a, c, g, or t
  misc_feature (7457)..(7457): n is a, c, g, or t
  misc_feature (7459)..(7461): n is a, c, g, or t
  misc_feature (7464)..(7467): n is a, c, g, or t
  misc_feature (7469)..(7469): n is a, c, g, or t
  misc_feature (7472)..(7476): n is a, c, g, or t
  misc_feature (7481)..(7481): n is a, c, g, or t
  misc_feature (7484)..(7485): n is a, c, g, or t
  misc_feature (7487)..(7487): n is a, c, g, or t
  misc_feature (7489)..(7490): n is a, c, g, or t
  misc_feature (7493)..(7497): n is a, c, g, or t
  misc_feature (7499)..(7506): n is a, c, g, or t
  misc_feature (7508)..(7508): n is a, c, g, or t
  misc_feature (7510)..(7510): n is a, c, g, or t
  misc_feature (7512)..(7513): n is a, c, g, or t
  misc_feature (7523)..(7524): n is a, c, g, or t
  misc_feature (7526)..(7526): n is a, c, g, or t
  misc_feature (7529)..(7529): n is a, c, g, or t
  misc_feature (7533)..(7538): n is a, c, g, or t
  misc_feature (7541)..(7545): n is a, c, g, or t
  misc_feature (7547)..(7549): n is a, c, g, or t
  misc_feature (7556)..(7556): n is a, c, g, or t
  misc_feature (7559)..(7559): n is a, c, g, or t
  misc_feature (7568)..(7569): n is a, c, g, or t
  misc_feature (7575)..(7576): n is a, c, g, or t
  misc_feature (7578)..(7580): n is a, c, g, or t
  misc_feature (7589)..(7590): n is a, c, g, or t
  misc_feature (7592)..(7592): n is a, c, g, or t
  misc_feature (7595)..(7598): n is a, c, g, or t
  misc_feature (7601)..(7601): n is a, c, g, or t
  misc_feature (7604)..(7604): n is a, c, g, or t
  misc_feature (7607)..(7607): n is a, c, g, or t
  misc_feature (7611)..(7613): n is a, c, g, or t
  misc_feature (7616)..(7616): n is a, c, g, or t
  misc_feature (7619)..(7619): n is a, c, g, or t
  misc_feature (7631)..(7631): n is a, c, g, or t
  misc_feature (7644)..(7644): n is a, c, g, or t
  misc_feature (7646)..(7647): n is a, c, g, or t
  misc_feature (7649)..(7649): n is a, c, g, or t
  misc_feature (7652)..(7652): n is a, c, g, or t
  misc_feature (7657)..(7658): n is a, c, g, or t
  misc_feature (7661)..(7662): n is a, c, g, or t
  misc_feature (7664)..(7664): n is a, c, g, or t
  misc_feature (7670)..(7670): n is a, c, g, or t
  misc_feature (7673)..(7673): n is a, c, g, or t
  misc_feature (7676)..(7676): n is a, c, g, or t
  misc_feature (7679)..(7679): n is a, c, g, or t
  misc_feature (7682)..(7682): n is a, c, g, or t
  misc_feature (7688)..(7691): n is a, c, g, or t
  misc_feature (7701)..(7701): n is a, c, g, or t
  misc_feature (7703)..(7703): n is a, c, g, or t
  misc_feature (7710)..(7710): n is a, c, g, or t
  misc_feature (7712)..(7712): n is a, c, g, or t
  misc_feature (7715)..(7715): n is a, c, g, or t
  misc_feature (7718)..(7721): n is a, c, g, or t
  misc_feature (7725)..(7725): n is a, c, g, or t
  misc_feature (7727)..(7727): n is a, c, g, or t
  misc_feature (7733)..(7733): n is a, c, g, or t
  misc_feature (7736)..(7736): n is a, c, g, or t
  misc_feature (7740)..(7744): n is a, c, g, or t
  misc_feature (7751)..(7753): n is a, c, g, or t
  misc_feature (7756)..(7758): n is a, c, g, or t
  misc_feature (7769)..(7769): n is a, c, g, or t
  misc_feature (7775)..(7775): n is a, c, g, or t
  misc_feature (7778)..(7778): n is a, c, g, or t
  misc_feature (7781)..(7781): n is a, c, g, or t
  misc_feature (7787)..(7787): n is a, c, g, or t
  misc_feature (7790)..(7791): n is a, c, g, or t
  misc_feature (7793)..(7793): n is a, c, g, or t
  misc_feature (7796)..(7796): n is a, c, g, or t
  misc_feature (7802)..(7802): n is a, c, g, or t
  misc_feature (7808)..(7809): n is a, c, g, or t
  misc_feature (7811)..(7811): n is a, c, g, or t
  misc_feature (7815)..(7816): n is a, c, g, or t
  misc_feature (7818)..(7819): n is a, c, g, or t
  misc_feature (7821)..(7823): n is a, c, g, or t
  misc_feature (7825)..(7829): n is a, c, g, or t
  misc_feature (7835)..(7835): n is a, c, g, or t
  misc_feature (7838)..(7838): n is a, c, g, or t
  misc_feature (7842)..(7842): n is a, c, g, or t
  misc_feature (7845)..(7846): n is a, c, g, or t
  misc_feature (7848)..(7848): n is a, c, g, or t
  misc_feature (7851)..(7851): n is a, c, g, or t
  misc_feature (7853)..(7854): n is a, c, g, or t
  misc_feature (7856)..(7859): n is a, c, g, or t
  misc_feature (7868)..(7868): n is a, c, g, or t
  misc_feature (7871)..(7872): n is a, c, g, or t
  misc_feature (7874)..(7877): n is a, c, g, or t
  misc_feature (7880)..(7882): n is a, c, g, or t
  misc_feature (7884)..(7884): n is a, c, g, or t
  misc_feature (7886)..(7889): n is a, c, g, or t
  misc_feature (7892)..(7892): n is a, c, g, or t
  misc_feature (7896)..(7896): n is a, c, g, or t
  misc_feature (7898)..(7899): n is a, c, g, or t
  misc_feature (7901)..(7901): n is a, c, g, or t
  misc_feature (7907)..(7907): n is a, c, g, or t
  misc_feature (7913)..(7913): n is a, c, g, or t
  misc_feature (7919)..(7919): n is a, c, g, or t
  misc_feature (7937)..(7937): n is a, c, g, or t
  misc_feature (7940)..(7941): n is a, c, g, or t
  misc_feature (7943)..(7943): n is a, c, g, or t
  misc_feature (7946)..(7946): n is a, c, g, or t
  misc_feature (7949)..(7949): n is a, c, g, or t
  misc_feature (7952)..(7953): n is a, c, g, or t
  misc_feature (7955)..(7955): n is a, c, g, or t
  misc_feature (7961)..(7961): n is a, c, g, or t
  misc_feature (7964)..(7965): n is a, c, g, or t
  misc_feature (7967)..(7968): n is a, c, g, or t
  misc_feature (7970)..(7970): n is a, c, g, or t
  misc_feature (7972)..(7972): n is a, c, g, or t
  misc_feature (7974)..(7974): n is a, c, g, or t
  misc_feature (7976)..(7976): n is a, c, g, or t
  misc_feature (7982)..(7982): n is a, c, g, or t
  misc_feature (7988)..(7988): n is a, c, g, or t
  misc_feature (7990)..(7991): n is a, c, g, or t
  misc_feature (7994)..(7995): n is a, c, g, or t
  misc_feature (7997)..(7997): n is a, c, g, or t
  misc_feature (8001)..(8001): n is a, c, g, or t
  misc_feature (8003)..(8004): n is a, c, g, or t
  misc_feature (8012)..(8012): n is a, c, g, or t
  misc_feature (8018)..(8018): n is a, c, g, or t
  misc_feature (8021)..(8022): n is a, c, g, or t
  misc_feature (8024)..(8025): n is a, c, g, or t
  misc_feature (8027)..(8027): n is a, c, g, or t
  misc_feature (8030)..(8034): n is a, c, g, or t
  misc_feature (8045)..(8045): n is a, c, g, or t
  misc_feature (8047)..(8049): n is a, c, g, or t
  misc_feature (8051)..(8051): n is a, c, g, or t
  misc_feature (8060)..(8060): n is a, c, g, or t
  misc_feature (8063)..(8065): n is a, c, g, or t
  misc_feature (8067)..(8067): n is a, c, g, or t
  misc_feature (8069)..(8070): n is a, c, g, or t
  misc_feature (8072)..(8072): n is a, c, g, or t
  misc_feature (8078)..(8078): n is a, c, g, or t
  misc_feature (8081)..(8081): n is a, c, g, or t
  misc_feature (8087)..(8087): n is a, c, g, or t
  misc_feature (8093)..(8093): n is a, c, g, or t
  misc_feature (8096)..(8096): n is a, c, g, or t
  misc_feature (8099)..(8099): n is a, c, g, or t
  misc_feature (8108)..(8108): n is a, c, g, or t
  misc_feature (8111)..(8111): n is a, c, g, or t
  misc_feature (8117)..(8117): n is a, c, g, or t
  misc_feature (8120)..(8120): n is a, c, g, or t
  misc_feature (8123)..(8123): n is a, c, g, or t
  misc_feature (8126)..(8126): n is a, c, g, or t
  misc_feature (8132)..(8132): n is a, c, g, or t
  misc_feature (8135)..(8136): n is a, c, g, or t
  misc_feature (8139)..(8139): n is a, c, g, or t
  misc_feature (8142)..(8143): n is a, c, g, or t
  misc_feature (8147)..(8147): n is a, c, g, or t
  misc_feature (8150)..(8150): n is a, c, g, or t
  misc_feature (8160)..(8160): n is a, c, g, or t
  misc_feature (8166)..(8166): n is a, c, g, or t
  misc_feature (8168)..(8169): n is a, c, g, or t
  misc_feature (8171)..(8171): n is a, c, g, or t
  misc_feature (8174)..(8175): n is a, c, g, or t
  misc_feature (8183)..(8183): n is a, c, g, or t
  misc_feature (8192)..(8192): n is a, c, g, or t
  misc_feature (8195)..(8195): n is a, c, g, or t
  misc_feature (8198)..(8199): n is a, c, g, or t
  misc_feature (8207)..(8208): n is a, c, g, or t
  misc_feature (8210)..(8211): n is a, c, g, or t
  misc_feature (8213)..(8213): n is a, c, g, or t
  misc_feature (8217)..(8218): n is a, c, g, or t
  misc_feature (8220)..(8221): n is a, c, g, or t
  misc_feature (8224)..(8224): n is a, c, g, or t
  misc_feature (8227)..(8227): n is a, c, g, or t
  misc_feature (8232)..(8232): n is a, c, g, or t
  misc_feature (8246)..(8247): n is a, c, g, or t
  misc_feature (8249)..(8249): n is a, c, g, or t
  misc_feature (8258)..(8258): n is a, c, g, or t
  misc_feature (8261)..(8261): n is a, c, g, or t
  misc_feature (8264)..(8264): n is a, c, g, or t
  misc_feature (8267)..(8267): n is a, c, g, or t
  misc_feature (8273)..(8273): n is a, c, g, or t
  misc_feature (8280)..(8280): n is a, c, g, or t
  misc_feature (8282)..(8282): n is a, c, g, or t
  misc_feature (8286)..(8286): n is a, c, g, or t
  misc_feature (8288)..(8289): n is a, c, g, or t
  misc_feature (8291)..(8291): n is a, c, g, or t
  misc_feature (8294)..(8294): n is a, c, g, or t
  misc_feature (8297)..(8297): n is a, c, g, or t
  misc_feature (8309)..(8309): n is a, c, g, or t
  misc_feature (8312)..(8312): n is a, c, g, or t
  misc_feature (8316)..(8316): n is a, c, g, or t
  misc_feature (8318)..(8319): n is a, c, g, or t
  misc_feature (8321)..(8321): n is a, c, g, or t
  misc_feature (8324)..(8324): n is a, c, g, or t
  misc_feature (8330)..(8330): n is a, c, g, or t
  misc_feature (8332)..(8332): n is a, c, g, or t
  misc_feature (8339)..(8339): n is a, c, g, or t
  misc_feature (8345)..(8345): n is a, c, g, or t
  misc_feature (8357)..(8357): n is a, c, g, or t
  misc_feature (8363)..(8364): n is a, c, g, or t
  misc_feature (8375)..(8375): n is a, c, g, or t
  misc_feature (8384)..(8384): n is a, c, g, or t
  misc_feature (8390)..(8391): n is a, c, g, or t
  misc_feature (8393)..(8393): n is a, c, g, or t
  misc_feature (8396)..(8396): n is a, c, g, or t
  misc_feature (8399)..(8401): n is a, c, g, or t
  misc_feature (8423)..(8426): n is a, c, g, or t
  misc_feature (8429)..(8429): n is a, c, g, or t
  misc_feature (8432)..(8432): n is a, c, g, or t
  misc_feature (8435)..(8435): n is a, c, g, or t
  misc_feature (8437)..(8445): n is a, c, g, or t
  misc_feature (8447)..(8447): n is a, c, g, or t
  misc_feature (8451)..(8451): n is a, c, g, or t
  misc_feature (8453)..(8453): n is a, c, g, or t
  misc_feature (8458)..(8463): n is a, c, g, or t
  misc_feature (8468)..(8468): n is a, c, g, or t
  misc_feature (8470)..(8470): n is a, c, g, or t
  misc_feature (8473)..(8473): n is a, c, g, or t
  misc_feature (8481)..(8483): n is a, c, g, or t
  misc_feature (8486)..(8487): n is a, c, g, or t
  misc_feature (8489)..(8489): n is a, c, g, or t
  misc_feature (8492)..(8492): n is a, c, g, or t
  misc_feature (8495)..(8495): n is a, c, g, or t
  misc_feature (8498)..(8498): n is a, c, g, or t
  misc_feature (8505)..(8505): n is a, c, g, or t
  misc_feature (8507)..(8510): n is a, c, g, or t
  misc_feature (8513)..(8514): n is a, c, g, or t
  misc_feature (8516)..(8516): n is a, c, g, or t
  misc_feature (8518)..(8518): n is a, c, g, or t
  misc_feature (8520)..(8520): n is a, c, g, or t
  misc_feature (8522)..(8522): n is a, c, g, or t
  misc_feature (8524)..(8526): n is a, c, g, or t
  misc_feature (8528)..(8529): n is a, c, g, or t
  misc_feature (8532)..(8535): n is a, c, g, or t
  misc_feature (8537)..(8538): n is a, c, g, or t
  misc_feature (8542)..(8546): n is a, c, g, or t
  misc_feature (8550)..(8550): n is a, c, g, or t
  misc_feature (8552)..(8554): n is a, c, g, or t
  misc_feature (8556)..(8556): n is a, c, g, or t
  misc_feature (8558)..(8559): n is a, c, g, or t
  misc_feature (8561)..(8564): n is a, c, g, or t
  misc_feature (8567)..(8567): n is a, c, g, or t
  misc_feature (8571)..(8571): n is a, c, g, or t
  misc_feature (8573)..(8576): n is a, c, g, or t
  misc_feature (8579)..(8579): n is a, c, g, or t
  misc_feature (8582)..(8583): n is a, c, g, or t
  misc_feature (8601)..(8609): n is a, c, g, or t
  misc_feature (8613)..(8613): n is a, c, g, or t
  misc_feature (8615)..(8618): n is a, c, g, or t
  misc_feature (8621)..(8625): n is a, c, g, or t
  misc_feature (8627)..(8627): n is a, c, g, or t
  misc_feature (8630)..(8631): n is a, c, g, or t
  misc_feature (8634)..(8636): n is a, c, g, or t
  misc_feature (8640)..(8641): n is a, c, g, or t
  misc_feature (8643)..(8647): n is a, c, g, or t
  misc_feature (8651)..(8651): n is a, c, g, or t
  misc_feature (8654)..(8654): n is a, c, g, or t
  misc_feature (8676)..(8676): n is a, c, g, or t
  misc_feature (8682)..(8685): n is a, c, g, or t
  misc_feature (8687)..(8687): n is a, c, g, or t
  misc_feature (8691)..(8692): n is a, c, g, or t
  misc_feature (8697)..(8704): n is a, c, g, or t
  misc_feature (8706)..(8711): n is a, c, g, or t
  misc_feature (8715)..(8715): n is a, c, g, or t
  misc_feature (8718)..(8718): n is a, c, g, or t
  misc_feature (8721)..(8724): n is a, c, g, or t
  misc_feature (8726)..(8730): n is a, c, g, or t
  misc_feature (8732)..(8732): n is a, c, g, or t
  misc_feature (8738)..(8738): n is a, c, g, or t
  misc_feature (8740)..(8740): n is a, c, g, or t
  misc_feature (8743)..(8744): n is a, c, g, or t
  misc_feature (8747)..(8748): n is a, c, g, or t
  misc_feature (8750)..(8751): n is a, c, g, or t
  misc_feature (8753)..(8753): n is a, c, g, or t
  misc_feature (8755)..(8762): n is a, c, g, or t
  misc_feature (8764)..(8765): n is a, c, g, or t
  misc_feature (8768)..(8769): n is a, c, g, or t
  misc_feature (8771)..(8776): n is a, c, g, or t
  misc_feature (8778)..(8779): n is a, c, g, or t
  misc_feature (8782)..(8783): n is a, c, g, or t
  misc_feature (8785)..(8786): n is a, c, g, or t
  misc_feature (8788)..(8788): n is a, c, g, or t
  misc_feature (8790)..(8793): n is a, c, g, or t
  misc_feature (8795)..(8798): n is a, c, g, or t
  misc_feature (8801)..(8801): n is a, c, g, or t
  misc_feature (8803)..(8803): n is a, c, g, or t
  misc_feature (8805)..(8805): n is a, c, g, or t
  misc_feature (8807)..(8809): n is a, c, g, or t
  misc_feature (8811)..(8813): n is a, c, g, or t
  misc_feature (8816)..(8819): n is a, c, g, or t
  misc_feature (8821)..(8822): n is a, c, g, or t
  misc_feature (8828)..(8828): n is a, c, g, or t
  misc_feature (8830)..(8830): n is a, c, g, or t
  misc_feature (8832)..(8832): n is a, c, g, or t
  misc_feature (8835)..(8836): n is a, c, g, or t
  misc_feature (8839)..(8839): n is a, c, g, or t
  misc_feature (8853)..(8853): n is a, c, g, or t
  misc_feature (8856)..(8864): n is a, c, g, or t
  misc_feature (8866)..(8870): n is a, c, g, or t
  misc_feature (8872)..(8872): n is a, c, g, or t
  misc_feature (8875)..(8877): n is a, c, g, or t
  misc_feature (8880)..(8882): n is a, c, g, or t
  misc_feature (8886)..(8887): n is a, c, g, or t
  misc_feature (8889)..(8891): n is a, c, g, or t
  misc_feature (8894)..(8894): n is a, c, g, or t
  misc_feature (8896)..(8897): n is a, c, g, or t
  misc_feature (8900)..(8900): n is a, c, g, or t
  misc_feature (8902)..(8902): n is a, c, g, or t
  misc_feature (8921)..(8922): n is a, c, g, or t
  misc_feature (8928)..(8928): n is a, c, g, or t
  misc_feature (8930)..(8933): n is a, c, g, or t
  misc_feature (8940)..(8943): n is a, c, g, or t
  misc_feature (8945)..(8945): n is a, c, g, or t
  misc_feature (8948)..(8950): n is a, c, g, or t
  misc_feature (8952)..(8953): n is a, c, g, or t
  misc_feature (8955)..(8956): n is a, c, g, or t
  misc_feature (8962)..(8964): n is a, c, g, or t
  misc_feature (8966)..(8966): n is a, c, g, or t
  misc_feature (8969)..(8969): n is a, c, g, or t
  misc_feature (8976)..(8977): n is a, c, g, or t
  misc_feature (8985)..(8985): n is a, c, g, or t
  misc_feature (8987)..(8988): n is a, c, g, or t
  misc_feature (8990)..(8990): n is a, c, g, or t
  misc_feature (8992)..(8992): n is a, c, g, or t
  misc_feature (8994)..(8994): n is a, c, g, or t
  misc_feature (8996)..(9001): n is a, c, g, or t
  misc_feature (9003)..(9003): n is a, c, g, or t
  misc_feature (9005)..(9006): n is a, c, g, or t
  misc_feature (9008)..(9008): n is a, c, g, or t
  misc_feature (9011)..(9012): n is a, c, g, or t
  misc_feature (9014)..(9014): n is a, c, g, or t
  misc_feature (9017)..(9017): n is a, c, g, or t
  misc_feature (9019)..(9027): n is a, c, g, or t
  misc_feature (9030)..(9032): n is a, c, g, or t
  misc_feature (9034)..(9035): n is a, c, g, or t
  misc_feature (9037)..(9040): n is a, c, g, or t
  misc_feature (9042)..(9042): n is a, c, g, or t
  misc_feature (9044)..(9050): n is a, c, g, or t
  misc_feature (9054)..(9054): n is a, c, g, or t
  misc_feature (9056)..(9056): n is a, c, g, or t
  misc_feature (9059)..(9062): n is a, c, g, or t
  misc_feature (9064)..(9066): n is a, c, g, or t
  misc_feature (9069)..(9069): n is a, c, g, or t
  misc_feature (9071)..(9071): n is a, c, g, or t
  misc_feature (9074)..(9074): n is a, c, g, or t
  misc_feature (9077)..(9077): n is a, c, g, or t
  misc_feature (9079)..(9079): n is a, c, g, or t
  misc_feature (9081)..(9084): n is a, c, g, or t
  misc_feature (9086)..(9089): n is a, c, g, or t
  misc_feature (9092)..(9093): n is a, c, g, or t
  misc_feature (9095)..(9099): n is a, c, g, or t
  misc_feature (9101)..(9102): n is a, c, g, or t
  misc_feature (9104)..(9104): n is a, c, g, or t
  misc_feature (9108)..(9108): n is a, c, g, or t
  misc_feature (9110)..(9112): n is a, c, g, or t
  misc_feature (9117)..(9120): n is a, c, g, or t
  misc_feature (9122)..(9124): n is a, c, g, or t
  misc_feature (9127)..(9127): n is a, c, g, or t
  misc_feature (9129)..(9130): n is a, c, g, or t
  misc_feature (9132)..(9134): n is a, c, g, or t
  misc_feature (9137)..(9142): n is a, c, g, or t
  misc_feature (9146)..(9147): n is a, c, g, or t
  misc_feature (9149)..(9163): n is a, c, g, or t
  misc_feature (9167)..(9175): n is a, c, g, or t
  misc_feature (9180)..(9183): n is a, c, g, or t
  misc_feature (9188)..(9188): n is a, c, g, or t
  misc_feature (9191)..(9192): n is a, c, g, or t
  misc_feature (9195)..(9204): n is a, c, g, or t
  misc_feature (9206)..(9206): n is a, c, g, or t
  misc_feature (9209)..(9213): n is a, c, g, or t
  misc_feature (9215)..(9215): n is a, c, g, or t
  misc_feature (9218)..(9219): n is a, c, g, or t
  misc_feature (9221)..(9222): n is a, c, g, or t
  misc_feature (9224)..(9224): n is a, c, g, or t
  misc_feature (9227)..(9228): n is a, c, g, or t
  misc_feature (9230)..(9231): n is a, c, g, or t
  misc_feature (9233)..(9237): n is a, c, g, or t
  misc_feature (9239)..(9239): n is a, c, g, or t
  misc_feature (9267)..(9267): n is a, c, g, or t
  misc_feature (9270)..(9270): n is a, c, g, or t
  misc_feature (9272)..(9273): n is a, c, g, or t
  misc_feature (9277)..(9277): n is a, c, g, or t
  misc_feature (9279)..(9281): n is a, c, g, or t
  misc_feature (9284)..(9286): n is a, c, g, or t
  misc_feature (9288)..(9296): n is a, c, g, or t
  misc_feature (9299)..(9304): n is a, c, g, or t
  misc_feature (9307)..(9309): n is a, c, g, or t
  misc_feature (9311)..(9313): n is a, c, g, or t
  misc_feature (9315)..(9324): n is a, c, g, or t
  misc_feature (9326)..(9328): n is a, c, g, or t
  misc_feature (9331)..(9332): n is a, c, g, or t
  misc_feature (9339)..(9343): n is a, c, g, or t
  misc_feature (9348)..(9352): n is a, c, g, or t
  misc_feature (9354)..(9360): n is a, c, g, or t
  misc_feature (9362)..(9365): n is a, c, g, or t
  misc_feature (9402)..(9403): n is a, c, g, or t
  misc_feature (9405)..(9407): n is a, c, g, or t
  misc_feature (9410)..(9413): n is a, c, g, or t
  misc_feature (9416)..(9416): n is a, c, g, or t
  misc_feature (9419)..(9422): n is a, c, g, or t
  misc_feature (9424)..(9424): n is a, c, g, or t
  misc_feature (9426)..(9428): n is a, c, g, or t
  misc_feature (9432)..(9439): n is a, c, g, or t
  misc_feature (9441)..(9443): n is a, c, g, or t
  misc_feature (9445)..(9448): n is a, c, g, or t
  misc_feature (9450)..(9450): n is a, c, g, or t
  misc_feature (9452)..(9453): n is a, c, g, or t
  misc_feature (9455)..(9461): n is a, c, g, or t
  misc_feature (9495)..(9495): n is a, c, g, or t
  misc_feature (9497)..(9497): n is a, c, g, or t
  misc_feature (9500)..(9500): n is a, c, g, or t
  misc_feature (9503)..(9508): n is a, c, g, or t
  misc_feature (9510)..(9510): n is a, c, g, or t
  misc_feature (9512)..(9512): n is a, c, g, or t
  misc_feature (9515)..(9516): n is a, c, g, or t
  misc_feature (9518)..(9518): n is a, c, g, or t
  misc_feature (9520)..(9520): n is a, c, g, or t
  misc_feature (9533)..(9533): n is a, c, g, or t
  misc_feature (9538)..(9539): n is a, c, g, or t
  misc_feature (9541)..(9543): n is a, c, g, or t
  misc_feature (9545)..(9545): n is a, c, g, or t
  misc_feature (9550)..(9558): n is a, c, g, or t
  misc_feature (9560)..(9562): n is a, c, g, or t
  misc_feature (9564)..(9565): n is a, c, g, or t
  misc_feature (9567)..(9574): n is a, c, g, or t
  misc_feature (9576)..(9584): n is a, c, g, or t
  misc_feature (9586)..(9587): n is a, c, g, or t
  misc_feature (9589)..(9594): n is a, c, g, or t
  misc_feature (9596)..(9596): n is a, c, g, or t
  misc_feature (9599)..(9599): n is a, c, g, or t
  misc_feature (9601)..(9601): n is a, c, g, or t
  misc_feature (9603)..(9604): n is a, c, g, or t
  misc_feature (9606)..(9610): n is a, c, g, or t
  misc_feature (9617)..(9617): n is a, c, g, or t
  misc_feature (9619)..(9619): n is a, c, g, or t
  misc_feature (9642)..(9642): n is a, c, g, or t
  misc_feature (9644)..(9647): n is a, c, g, or t
  misc_feature (9649)..(9652): n is a, c, g, or t
  misc_feature (9657)..(9657): n is a, c, g, or t
  misc_feature (9659)..(9663): n is a, c, g, or t
  misc_feature (9665)..(9666): n is a, c, g, or t
  misc_feature (9670)..(9674): n is a, c, g, or t
  misc_feature (9677)..(9683): n is a, c, g, or t
  misc_feature (9686)..(9686): n is a, c, g, or t
  misc_feature (9688)..(9688): n is a, c, g, or t
  misc_feature (9690)..(9691): n is a, c, g, or t
  misc_feature (9693)..(9694): n is a, c, g, or t
  misc_feature (9697)..(9698): n is a, c, g, or t
  misc_feature (9700)..(9702): n is a, c, g, or t
  misc_feature (9704)..(9708): n is a, c, g, or t
  misc_feature (9710)..(9711): n is a, c, g, or t
  misc_feature (9714)..(9717): n is a, c, g, or t
  misc_feature (9719)..(9719): n is a, c, g, or t
  misc_feature (9721)..(9721): n is a, c, g, or t
  misc_feature (9725)..(9726): n is a, c, g, or t
  misc_feature (9728)..(9728): n is a, c, g, or t
  misc_feature (9730)..(9732): n is a, c, g, or t
  misc_feature (9734)..(9734): n is a, c, g, or t
  misc_feature (9736)..(9740): n is a, c, g, or t
  misc_feature (9745)..(9745): n is a, c, g, or t
  misc_feature (9750)..(9752): n is a, c, g, or t
  misc_feature (9754)..(9754): n is a, c, g, or t
  misc_feature (9758)..(9758): n is a, c, g, or t
  misc_feature (9800)..(9801): n is a, c, g, or t
  misc_feature (9803)..(9804): n is a, c, g, or t
  misc_feature (9806)..(9810): n is a, c, g, or t
  misc_feature (9813)..(9813): n is a, c, g, or t
  misc_feature (9815)..(9815): n is a, c, g, or t
  misc_feature (9817)..(9822): n is a, c, g, or t
  misc_feature (9830)..(9835): n is a, c, g, or t
  misc_feature (9840)..(9841): n is a, c, g, or t
  misc_feature (9843)..(9845): n is a, c, g, or t
  misc_feature (9849)..(9854): n is a, c, g, or t
  misc_feature (9856)..(9859): n is a, c, g, or t
  misc_feature (9861)..(9863): n is a, c, g, or t
  misc_feature (9877)..(9878): n is a, c, g, or t
  misc_feature (9881)..(9881): n is a, c, g, or t
  misc_feature (9883)..(9889): n is a, c, g, or t
  misc_feature (9891)..(9894): n is a, c, g, or t
  misc_feature (9896)..(9898): n is a, c, g, or t
  misc_feature (9900)..(9904): n is a, c, g, or t
  misc_feature (9906)..(9906): n is a, c, g, or t
  misc_feature (9908)..(9909): n is a, c, g, or t
  misc_feature (9914)..(9915): n is a, c, g, or t
  misc_feature (9917)..(9920): n is a, c, g, or t
  misc_feature (9923)..(9923): n is a, c, g, or t
  misc_feature (9925)..(9932): n is a, c, g, or t
  misc_feature (9934)..(9934): n is a, c, g, or t
  misc_feature (9936)..(9936): n is a, c, g, or t
  misc_feature (9938)..(9940): n is a, c, g, or t
  misc_feature (9942)..(9944): n is a, c, g, or t
  misc_feature (9946)..(9949): n is a, c, g, or t
  misc_feature (9951)..(9951): n is a, c, g, or t
  misc_feature (9953)..(9959): n is a, c, g, or t
  misc_feature (9996)..(9996): n is a, c, g, or t
  misc_feature (10003)..(10003): n is a, c, g, or t
  misc_feature (10005)..(10006): n is a, c, g, or t
  misc_feature (10008)..(10008): n is a, c, g, or t
  misc_feature (10010)..(10011): n is a, c, g, or t
  misc_feature (10021)..(10024): n is a, c, g, or t
  misc_feature (10026)..(10028): n is a, c, g, or t
  misc_feature (10034)..(10036): n is a, c, g, or t
  misc_feature (10038)..(10041): n is a, c, g, or t
  misc_feature (10043)..(10043): n is a, c, g, or t
  misc_feature (10046)..(10047): n is a, c, g, or t
  misc_feature (10051)..(10051): n is a, c, g, or t
  misc_feature (10053)..(10053): n is a, c, g, or t
  misc_feature (10055)..(10056): n is a, c, g, or t
  misc_feature (10060)..(10065): n is a, c, g, or t
  misc_feature (10068)..(10068): n is a, c, g, or t
  misc_feature (10073)..(10074): n is a, c, g, or t
  misc_feature (10077)..(10078): n is a, c, g, or t
  misc_feature (10080)..(10082): n is a, c, g, or t
  misc_feature (10084)..(10084): n is a, c, g, or t
  misc_feature (10087)..(10089): n is a, c, g, or t
  misc_feature (10091)..(10091): n is a, c, g, or t
  misc_feature (10095)..(10095): n is a, c, g, or t
  misc_feature (10097)..(10097): n is a, c, g, or t
  misc_feature (10100)..(10100): n is a, c, g, or t
  misc_feature (10102)..(10106): n is a, c, g, or t
  misc_feature (10108)..(10112): n is a, c, g, or t
  misc_feature (10128)..(10134): n is a, c, g, or t
  misc_feature (10136)..(10138): n is a, c, g, or t
  misc_feature (10142)..(10142): n is a, c, g, or t
  misc_feature (10151)..(10151): n is a, c, g, or t
  misc_feature (10154)..(10154): n is a, c, g, or t
  misc_feature (10156)..(10157): n is a, c, g, or t
  misc_feature (10160)..(10162): n is a, c, g, or t
  misc_feature (10164)..(10164): n is a, c, g, or t
  misc_feature (10166)..(10167): n is a, c, g, or t
  misc_feature (10169)..(10173): n is a, c, g, or t
  misc_feature (10176)..(10176): n is a, c, g, or t
  misc_feature (10178)..(10181): n is a, c, g, or t
  misc_feature (10190)..(10190): n is a, c, g, or t
  misc_feature (10192)..(10192): n is a, c, g, or t
  misc_feature (10194)..(10194): n is a, c, g, or t
  misc_feature (10196)..(10196): n is a, c, g, or t
  misc_feature (10198)..(10199): n is a, c, g, or t
  misc_feature (10201)..(10205): n is a, c, g, or t
  misc_feature (10207)..(10208): n is a, c, g, or t
  misc_feature (10210)..(10211): n is a, c, g, or t
  misc_feature (10213)..(10214): n is a, c, g, or t
  misc_feature (10217)..(10218): n is a, c, g, or t
  misc_feature (10220)..(10220): n is a, c, g, or t
  misc_feature (10222)..(10222): n is a, c, g, or t
  misc_feature (10225)..(10227): n is a, c, g, or t
  misc_feature (10229)..(10235): n is a, c, g, or t
  misc_feature (10237)..(10240): n is a, c, g, or t
  misc_feature (10242)..(10243): n is a, c, g, or t
  misc_feature (10247)..(10247): n is a, c, g, or t
  misc_feature (10249)..(10249): n is a, c, g, or t
  misc_feature (10251)..(10253): n is a, c, g, or t
  misc_feature (10255)..(10258): n is a, c, g, or t
  misc_feature (10260)..(10260): n is a, c, g, or t
  misc_feature (10262)..(10265): n is a, c, g, or t
  misc_feature (10269)..(10269): n is a, c, g, or t
  misc_feature (10272)..(10273): n is a, c, g, or t
  misc_feature (10275)..(10277): n is a, c, g, or t
  misc_feature (10280)..(10281): n is a, c, g, or t
  misc_feature (10283)..(10289): n is a, c, g, or t
  misc_feature (10291)..(10293): n is a, c, g, or t
  misc_feature (10295)..(10295): n is a, c, g, or t
  misc_feature (10306)..(10306): n is a, c, g, or t
  misc_feature (10312)..(10312): n is a, c, g, or t
  misc_feature (10315)..(10317): n is a, c, g, or t
  misc_feature (10323)..(10327): n is a, c, g, or t
  misc_feature (10329)..(10329): n is a, c, g, or t
  misc_feature (10331)..(10331): n is a, c, g, or t
  misc_feature (10333)..(10335): n is a, c, g, or t
  misc_feature (10337)..(10338): n is a, c, g, or t
  misc_feature (10340)..(10341): n is a, c, g, or t
  misc_feature (10343)..(10350): n is a, c, g, or t
  misc_feature (10352)..(10352): n is a, c, g, or t
  misc_feature (10355)..(10355): n is a, c, g, or t
  misc_feature (10357)..(10359): n is a, c, g, or t
  misc_feature (10361)..(10362): n is a, c, g, or t
  misc_feature (10364)..(10365): n is a, c, g, or t
  misc_feature (10367)..(10367): n is a, c, g, or t
  misc_feature (10390)..(10395): n is a, c, g, or t
  misc_feature (10397)..(10400): n is a, c, g, or t
  misc_feature (10402)..(10402): n is a, c, g, or t
  misc_feature (10404)..(10412): n is a, c, g, or t
  misc_feature (10415)..(10417): n is a, c, g, or t
  misc_feature (10420)..(10420): n is a, c, g, or t
  misc_feature (10422)..(10422): n is a, c, g, or t
  misc_feature (10424)..(10424): n is a, c, g, or t
  misc_feature (10427)..(10431): n is a, c, g, or t
  misc_feature (10433)..(10433): n is a, c, g, or t
  misc_feature (10436)..(10436): n is a, c, g, or t
  misc_feature (10438)..(10438): n is a, c, g, or t
  misc_feature (10440)..(10440): n is a, c, g, or t
  misc_feature (10442)..(10442): n is a, c, g, or t
  misc_feature (10459)..(10459): n is a, c, g, or t
  misc_feature (10463)..(10463): n is a, c, g, or t
  misc_feature (10467)..(10468): n is a, c, g, or t
  misc_feature (10471)..(10472): n is a, c, g, or t
  misc_feature (10476)..(10476): n is a, c, g, or t
  misc_feature (10478)..(10479): n is a, c, g, or t
  misc_feature (10481)..(10482): n is a, c, g, or t
  misc_feature (10484)..(10498): n is a, c, g, or t
  misc_feature (10500)..(10506): n is a, c, g, or t
  misc_feature (10508)..(10509): n is a, c, g, or t
  misc_feature (10511)..(10511): n is a, c, g, or t
  misc_feature (10514)..(10516): n is a, c, g, or t
  misc_feature (10582)..(10582): n is a, c, g, or t
  misc_feature (10584)..(10587): n is a, c, g, or t
  misc_feature (10589)..(10589): n is a, c, g, or t
  misc_feature (10591)..(10591): n is a, c, g, or t
  misc_feature (10593)..(10598): n is a, c, g, or t
  misc_feature (10600)..(10602): n is a, c, g, or t
  misc_feature (10605)..(10605): n is a, c, g, or t
  misc_feature (10607)..(10608): n is a, c, g, or t
  misc_feature (10610)..(10610): n is a, c, g, or t
  misc_feature (10612)..(10612): n is a, c, g, or t
  misc_feature (10614)..(10614): n is a, c, g, or t
  misc_feature (10617)..(10617): n is a, c, g, or t
  misc_feature (10619)..(10624): n is a, c, g, or t
  misc_feature (10626)..(10634): n is a, c, g, or t
  misc_feature (10636)..(10638): n is a, c, g, or t
  misc_feature (10643)..(10647): n is a, c, g, or t
  misc_feature (10651)..(10651): n is a, c, g, or t
  misc_feature (10654)..(10656): n is a, c, g, or t
  misc_feature (10658)..(10658): n is a, c, g, or t
  misc_feature (10660)..(10666): n is a, c, g, or t
  misc_feature (10669)..(10669): n is a, c, g, or t
  misc_feature (10671)..(10673): n is a, c, g, or t
  misc_feature (10676)..(10677): n is a, c, g, or t
  misc_feature (10680)..(10687): n is a, c, g, or t
  misc_feature (10689)..(10696): n is a, c, g, or t
  misc_feature (10698)..(10698): n is a, c, g, or t
  misc_feature (10700)..(10700): n is a, c, g, or t
  misc_feature (10702)..(10704): n is a, c, g, or t
  misc_feature (10706)..(10706): n is a, c, g, or t
  misc_feature (10709)..(10715): n is a, c, g, or t
  misc_feature (10717)..(10717): n is a, c, g, or t
  misc_feature (10719)..(10719): n is a, c, g, or t
  misc_feature (10722)..(10723): n is a, c, g, or t
  misc_feature (10728)..(10728): n is a, c, g, or t
  misc_feature (10731)..(10731): n is a, c, g, or t
  misc_feature (10734)..(10735): n is a, c, g, or t
  misc_feature (10737)..(10737): n is a, c, g, or t
  misc_feature (10739)..(10739): n is a, c, g, or t
  misc_feature (10742)..(10743): n is a, c, g, or t
  misc_feature (10745)..(10749): n is a, c, g, or t
  misc_feature (10751)..(10751): n is a, c, g, or t
  misc_feature (10761)..(10761): n is a, c, g, or t
  misc_feature (10764)..(10767): n is a, c, g, or t
  misc_feature (10769)..(10769): n is a, c, g, or t
  misc_feature (10772)..(10772): n is a, c, g, or t
  misc_feature (10775)..(10782): n is a, c, g, or t
  misc_feature (10784)..(10787): n is a, c, g, or t
  misc_feature (10791)..(10791): n is a, c, g, or t
  misc_feature (10795)..(10795): n is a, c, g, or t
  misc_feature (10797)..(10799): n is a, c, g, or t
  misc_feature (10802)..(10803): n is a, c, g, or t
  misc_feature (10805)..(10805): n is a, c, g, or t
  misc_feature (10808)..(10808): n is a, c, g, or t
  misc_feature (10810)..(10810): n is a, c, g, or t
  misc_feature (10812)..(10813): n is a, c, g, or t
  misc_feature (10817)..(10832): n is a, c, g, or t
  misc_feature (10839)..(10840): n is a, c, g, or t
  misc_feature (10842)..(10844): n is a, c, g, or t
  misc_feature (10846)..(10848): n is a, c, g, or t
  misc_feature (10850)..(10852): n is a, c, g, or t
  misc_feature (10854)..(10854): n is a, c, g, or t
  misc_feature (10856)..(10857): n is a, c, g, or t
  misc_feature (10859)..(10859): n is a, c, g, or t
  misc_feature (10865)..(10869): n is a, c, g, or t
  misc_feature (10874)..(10877): n is a, c, g, or t
  misc_feature (10881)..(10882): n is a, c, g, or t
  misc_feature (10886)..(10887): n is a, c, g, or t
  misc_feature (10890)..(10890): n is a, c, g, or t
  misc_feature (10893)..(10893): n is a, c, g, or t
  misc_feature (10899)..(10901): n is a, c, g, or t
  misc_feature (10904)..(10904): n is a, c, g, or t
  misc_feature (10907)..(10910): n is a, c, g, or t
  misc_feature (10912)..(10912): n is a, c, g, or t
  misc_feature (10914)..(10916): n is a, c, g, or t
  misc_feature (10921)..(10922): n is a, c, g, or t
  misc_feature (10925)..(10925): n is a, c, g, or t
  misc_feature (10928)..(10929): n is a, c, g, or t
  misc_feature (10931)..(10934): n is a, c, g, or t
  misc_feature (10937)..(10940): n is a, c, g, or t
  misc_feature (10945)..(10946): n is a, c, g, or t
  misc_feature (10949)..(10949): n is a, c, g, or t
  misc_feature (11004)..(11004): n is a, c, g, or t
  misc_feature (11007)..(11018): n is a, c, g, or t
  misc_feature (11020)..(11022): n is a, c, g, or t
  misc_feature (11027)..(11027): n is a, c, g, or t
  misc_feature (11030)..(11030): n is a, c, g, or t
  misc_feature (11033)..(11033): n is a, c, g, or t
  misc_feature (11035)..(11035): n is a, c, g, or t
  misc_feature (11038)..(11042): n is a, c, g, or t
  misc_feature (11049)..(11049): n is a, c, g, or t
  misc_feature (11051)..(11051): n is a, c, g, or t
  misc_feature (11053)..(11053): n is a, c, g, or t
  misc_feature (11057)..(11057): n is a, c, g, or t
  misc_feature (11059)..(11059): n is a, c, g, or t
  misc_feature (11061)..(11069): n is a, c, g, or t
  misc_feature (11072)..(11073): n is a, c, g, or t
  misc_feature (11077)..(11082): n is a, c, g, or t
  misc_feature (11084)..(11084): n is a, c, g, or t
  misc_feature (11089)..(11093): n is a, c, g, or t
  misc_feature (11095)..(11095): n is a, c, g, or t
  misc_feature (11097)..(11098): n is a, c, g, or t
  misc_feature (11101)..(11105): n is a, c, g, or t
  misc_feature (11107)..(11108): n is a, c, g, or t
  misc_feature (11111)..(11116): n is a, c, g, or t
  misc_feature (11118)..(11118): n is a, c, g, or t
  misc_feature (11120)..(11125): n is a, c, g, or t
  misc_feature (11127)..(11127): n is a, c, g, or t
  misc_feature (11129)..(11129): n is a, c, g, or t
  misc_feature (11133)..(11138): n is a, c, g, or t
  misc_feature (11143)..(11144): n is a, c, g, or t
  misc_feature (11150)..(11151): n is a, c, g, or t
  misc_feature (11156)..(11156): n is a, c, g, or t
  misc_feature (11162)..(11162): n is a, c, g, or t
  misc_feature (11164)..(11164): n is a, c, g, or t
  misc_feature (11171)..(11172): n is a, c, g, or t
  misc_feature (11174)..(11174): n is a, c, g, or t
  misc_feature (11177)..(11178): n is a, c, g, or t
  misc_feature (11180)..(11180): n is a, c, g, or t
  misc_feature (11182)..(11182): n is a, c, g, or t
  misc_feature (11189)..(11189): n is a, c, g, or t
  misc_feature (11192)..(11192): n is a, c, g, or t
  misc_feature (11195)..(11201): n is a, c, g, or t
  misc_feature (11204)..(11204): n is a, c, g, or t
  misc_feature (11206)..(11209): n is a, c, g, or t
  misc_feature (11220)..(11222): n is a, c, g, or t
  misc_feature (11244)..(11244): n is a, c, g, or t
  misc_feature (11257)..(11259): n is a, c, g, or t
  misc_feature (11261)..(11262): n is a, c, g, or t
  misc_feature (11264)..(11264): n is a, c, g, or t
  misc_feature (11309)..(11310): n is a, c, g, or t
  misc_feature (11312)..(11316): n is a, c, g, or t
  misc_feature (11318)..(11321): n is a, c, g, or t
  misc_feature (11327)..(11331): n is a, c, g, or t
  misc_feature (11333)..(11334): n is a, c, g, or t
  misc_feature (11336)..(11337): n is a, c, g, or t
  misc_feature (11340)..(11340): n is a, c, g, or t
  misc_feature (11358)..(11358): n is a, c, g, or t
  misc_feature (11360)..(11360): n is a, c, g, or t
  misc_feature (11367)..(11368): n is a, c, g, or t
  misc_feature (11373)..(11373): n is a, c, g, or t
  misc_feature (11375)..(11380): n is a, c, g, or t
  misc_feature (11382)..(11382): n is a, c, g, or t
  misc_feature (11384)..(11384): n is a, c, g, or t
aatnaannnannntanngnnttnnnttatnnnananannnnnanntnnnnaanntnntnannnncnnncnngntnnaannnncttnccgactncgngnnatataccannttgtaaactggtacgtagccagactacgtactgtaataactggagtcccgaattacgcgactctgtaaaccccggtgttccgctagacggatcactgtttaactngtgttnnnntnatncnannntnncnannnnnannannntngnnnnnctntcaaacaccacgacgttctttcggnncnnnannntnannnngganttnctcannngnnntcnnnnnnnntccnnncnttnnnnnntggatgaaccnnngnnnnnnncaacananncnannnnntcngtngtgnnntcnnntttaaccgtgtaataccgttaaacaaccatgtcttctnngnaanncaanttngnccttgcctnnnccgcnnccgcnncnnnnancgnnnnctcnnnngangtgntacctccnnctttgcgacttgatagaacaactgcacttccatcatttggaactgctgaggaccggacttgctcctcacgcacccaactcgttgttggtgcatcgttcttctttcgggaagcactgtctcactgtctccggatttcactttccggggtctgtctagcgctctactgagcccttctctcttcgtctcttggccaaggacgattatacactttcatcatggcngctacaggaaaatccctcggcattgatgattnttcgnannanncnnttntngatnanntcncnnanaannntnnnctcgacnnngnnganannanntcnnagnnnnttaatnnnannnttntncgnnanntnntngnnannncnnannnnganganntngtcnnnnntgcnnnnnttgacnntncnnncnannnnnntnntncnaagnntnnnnanaanaaantcnnngtnnatcananantntccaangannannaanntnncctnnganannnnttttgnnnnccgttnaanattaggctcgacttttcnanaaatgctnnngantnngncgcncatncnttnnntcgngctnanngtnntctntcnnnnngnaaantnntncnnnannnntgtggnattnnncnnnnntccnnnccnccnnnnggntangatgnngtntacaaagacgttggtggnaanccnntnacncatctnnannnnggtgannnntacgtncacacntgtannccnntnctntcnaanaatgacgacaaacgtcattcnnnttannnnnanannctncgnnnttntatctactctcatgtatgtcnancnnctnacnnncatnnnnnnntnnncaancgtcaacatttggcnnnacannntnannnngacncncnngtnatntgtnacagnatntctcaaaantgttnnattaaagcnnnannnttnattttcctncattcnacttatgacatgactcntnnnnanatngcngangcnatgnannnngctgangcnnnaanngcnaanggntnnntncatttcantccnnnnatnctntatganaannnnggtnnnctnnacnatgnnntgaatttnnantnngantgtngnnccnnnnntnntnnnnnnnngnattntnntnnantnggaaancttgccggacatgccgttagtctgtacaatagctttcgcaacaaatccgaccggataatgaaannngtnnnnnacggnnnnatnnanatcagnttttggttnnnnaacgatanccanganggntatgaacannnnttcnntanntatntngctctncttcgnactnncngaatcgcatcnnctnnnnnnnatnnacgnnnntanaangtnnagtttgaggannaganngangatgacntngnnttntttgnaatnngncaatcnatnantggnncnattccncgatccnacntntttcgnancttnacnnanncngctctngcnnanaaaatnatnntntactnntggnnntggganactnttaannnnggnannntntnnnnnnntntnnnnnntcnntctggtgttatgnnncccnnnngtnttgtngttccnnnnnaattnttcnnnaanntntnngnntatgctganactctnncnganncnaagttcactgtnnaaaacnttntnanngcngntnnnannttnaanacncgtgangtnattnntggncannnnnttggnntngtntctganccnntcganccngntnnnntnnanannntngntnttncnatntatntnntnacttanntnnnnaattangantgnannaagncnntnnnnactntgaaaanngangaagancgngtncgnnntnnnancancnnnnnnttnttnnnncgnttgttcnnnannnnnntnngnnntcnnngnaatcatnnngtnnnnnannnnnnnnnnncgannnncannntnnnnnnnganatnaagnnnntnnncnncncngangacncnnannnnncnnnngntaannanctnnntacngaggagaggtctcgtctgagtaacnnnnanannatnntncanggnntnnnnnnnttnnccgnngtnnatngncgnttcgnnattnnnnttcgtgannnnntnnnncncttnntnacnnttgangaaganctngannntntnnnngtngnnnnnnnnnnnnncnannnnnnnntnnnnncngannnnncnntnnnnnnnnnnnttgaccctgntnnnntncgtgangccntnatnnntnnncttgaanannngnnnnnnantganantgnctntnacnntnctnnnntngttnnnnnntatncttgtannncngacctcncantnnnccnnaananntcnaangganactgtntnttccantcnntgatngacnnntgnnnatttcnngnnntnncannangtganntncgnnncagnctnnnnaantctacntanttnnncnanntgnnngacnntnctnnnnnangnnnntnnntnnanntnantganggtttgtcccnnnanggtgtttacgnnnatntnnnnacnttcntncttntntcnntnganttnnanntangtgtttgcgtncacnntnanggnggtcgcgaantnannnnncnnttnnncnntnnnggannngnnnnnntnnatcattttnnnnttnnnnataaccattgntcnnnnctnanannnnnncataanttcgangnngttccnncnnnnnnnttntcnnnnctggatgacnnncnnnnnncnnannanncnacngnnncccgnganaannattttnnnnnntttttcganntnnannnnnannnncctncannnagtnanttcnnnnnnnnnnttannnctgcnaannatnnntattnnggccctttnnnnganntnggnnanggnnnntatntcgaatgtngntcnggtntnaagacngcngaaatgttcgnncgctattttnntannnntgagnncgagtcngctntntcnatnggtggngctccnggtgntgaagtncagtatntgcannntaanaannntggnatnngngtnttcggtatnacnnatacngannngatngatttnnnanntgcnntnnntgannancnnnnnttnnnncagctnnncggnganacttntgatggtgacatcancnnnnnannnaatnnnnttgnnttnnncgannnnatnnannnnggannntanncnnnnggtgtngnntttttcggtggngacntngcnanngttnctnananngannntnntnnngactncnnngnnnntgcnnannttgtnnncnnngagatngtnnttnnnanngctntntcagcgntnaanaanggtggtnangcatanttcaaggtntttgntctgnnnnnnnnnnanatnccnnannncnttnatntnntnnanaannnnttcgannatgtnnnnntcgtnaaactnganacttcncgcgccgcctntactgaantncanntnatttgtnntgnnaaacgctctcaccctggtagtgagttnnnnnccaancnnncnaanganntncnnnnnnnttnttacacngttaatgtcgagaacttttataaacaaanctnngaagagnntntnntnnnnnntnannnnnnnganntnncnnnngnntnnnnnnnnaannnnnnnnatnnncnnaannngaagcattcgtataaccgctcgtttgtcttggacagatctcttattctatcaaaacttatggaattnnannncnnnntcannnntggncttnnnnnnnnnnanaagtgtttnnacannntnggtnnnnntnnnnnncnnnncnnncnntttnctgangnaannattgagggatnncgtgnnnnnntntgtctngntnnnnnggtntctaagtacgacttcaattctttgagannnnnnggtgntntnnnnncnnntgtnnnncgngaacgtgctgtggttgtggagacatttgatgattgtggcgattatgtttcgatcatatcancnntnnncaanntttacncnntcgnttttnnnnnncgtgangttgnnnntganntnttcctgaataatgtcgtacttnnngacntnntggntnacgcnganntnnntnnnnangtnnanatatctttatgccaacttccggncgccntannngnngnngncntcactcncncnnnnntnnannatnnaccnnnnntngntgangangcnntngtttcgtgcaataggcatgactatgacacagcttttgttgangnnnttntngnnnatcctnnncctgnnntngnnnnnccatctgaacctgaagtaataattccannnnnnnncnnnntnannnannnannnncnatnnanaagntnnnnncnnnnantgannnnnnngntnnnttnacnnnnntngnnnaaantnagnctancggnatnacnnnnnnnncgccnnnngtcntnaannntnntnncntnnnnnncnnnnnnnnnncnnangnnncnnnanannnnnctgannanccnnttgtngaaaagnnnnnnnntnnnttngnngannntnnngnnnannanntcacnccnccaagaatccaannnnacgnntatngngcngcnatgnntgagtncntngaactcannaanntnactnnnnnntnnnanntcnncaancannnncgnntgttngagacacgtgatcctnanaggntnnnnaatnnnnncntccnncnnacnaannctttnntnnnnnangannnnangnntantggaaatttcnnnnnnntcnnntgcaatggtaagntnnctaanggtnangnnntncnntacnnattcggnnannnnanngnngnananaanatagtctataacaagtnnttcgacnntgnnnnnttcntnnnnntcgnnganatnaancgtnncatnnntnnngnnggnnnntnnctnntttctgantactgtgnnnttnntntngangaggaaatgatngangcntnnnnnnnngtctatgcctctgaagacatnnatnanttnannntnccnnatgnnnnngnnatngtncaagcngntgctggttgtggnaagacnnanttnnttgtcaanaantntntnccanctnncagaannnnangcgcnagnaanntnntnctnnnctcnacnntnganggnanngatgantttnnnngacgnatnnanaannnnnacnnnntngaantnnaanngnaanannnnantnaccgtntncgnacnntngcnagctttntngtcaactncnnnnnnaananngcaaaggtcactcttaataannnnnntacnntgtttattgatgaagcncttatgncncatcctggtnnnntnttntnngccatngcnntttcnggtgcnanngnantnnnnntncttggngacntnntncanatnccntnngttaaccgnacnccngcnttnnnntnnaagtatnannnnctnnnnnacttngtcncnatnnnnganacncccctgtanatntcttatcgntgtcctnctgangtcgctnncngnctnnanncnnattanggtaagtcacttaaaggcctgaccntnnannnnaannncaaaaanggntnnaantntggnagcgtctctaagcttgtnatganntcngctgtnagnnnnnntnnnaacacntgnanngnngtncnnntnaanaatnnnganaacttcnannangaggctnannannanntnnagnnnctnnnnttcactcagnntganaanannaanttnnagnnnnnnnnncttnnngtntttacagattncnnttcnactntncacgagtntcaaggtaangaagctnangnnatngntgtcgtccgnctnnatccntnnnnnnnnnangaaatntntntncgtntnaantangcncttgttgcnctnactagncanacnnannanctcacntantacactnttcgtgtnncnacngacgcnntnncnannntnatnnangtnnatggtannacnnnnnangnnnnnnnntctnnngangannntnnncnnnncntncanntnncnnnnggtgntggtgannntgnngngtttnnnttcgcnnannacnntnctnnnncancntnnncnnctntgannnnngttaanncnncnntnacnnnnntnncnnnncnnaatcgnntctntttngtncctcnnntcggnannnantnngatnnnanannnaanccntnnntcatgnnatcnnnnntnnnnannntnnnnaantnnnnnggtnanntnnatntntttgtnnnttcnncngtntnnnnnaannagaaanncnacntgannangntnannnagtnnctnnnnnnnntngnnnnnaannnnnntnnnnnngnngncnnnnnnatcttnnnngctggtncngtnnannntgacatngannnngnngtnntngnnnanntnntntncaanncnntnaannnttatnnntnnnnnntttgnnncannnnnnatgnnnacgatgtncctnnnnangtnttcgaacttnnnnnnnnnaanggnatnnntnnnnttncnaannnnnngntnnnnnncnnngannnnnnnnnnnccgannnnnnnnntnttnnnnntgnnnctnnttgtnnntttnanntnnntnnngcncaaanntttntnancagtntctttnctnannntnnntncatngacnantcttttgatgnntnngacgtnnnnaannnnganntnaacnttgaantnggngatatnncnttntcncnnntnnntnntnnanannnngnnnnnncntatganannatgantccnannntgngcncncctnnncctnnnntncgnnantanaactnncgngaaatnntgttngctcttgaaaancgnaancgcaangtnccnnanntnaacggngtcgtngacnntgangnnnnntcntctganatgntnganncnttgntnngngaatgnttnganccnngntancnnntgnnnntncannnnnctganccnntnannatnnnnncnnnnnnnntngntnngtggttgaannancancctnnnnnngtnnnnnannngattgtnccngattttgcnntgcacnntnnngctcttaannantannnnttntcnatnaagnnnaanccnaaacctaatctnactgttgatgctncnncntcntatgnngcnntncagacnatngtntancangaaaannnnattaatgccntnttttgtncnatnttnnnngagntnaagaancgngtcnnnnnttctctnnngcnnnacaataatgtnaaaatnttntcngatatntcnncngangatttngaagannantgtnntnnannntnnnnnaaatanggnaaantgnntntgntnnannnngacattccnccnncnnnnctnnntncnnnnttngatnanntngagatngacatnagtaantacgacaagtctcaacgnganntngcnctnganntngaatgnaanntnntncngnantttggngtcgcngnnganntngtcnanntgtggttnaatgcncanntnntnacnnnnntttatgacaanannncnaaattgaangcnnngntnncntatcancgnaagtcnggtgangcntcnacttttatnggnaacacnctnttnttnatggcngtnnttngcnntctnatncctgtttctnagttgnanntngcnntcttttcnggtgatgantcnctnntttacggnnannancttnngnngtntanggacnctcagcattttggnntnatgttcaanctnganatnaaattnttccctnantttnannantcntanttttgttcaaanttnttgntnntngtngacgancnttggacntttacncctgatccagtnaaattnntcatcaaactnggtcgacangatttnntnaanccnnntcacgtagaagaataccgtatnnnnttnatnganannnnnnnnnantacnanaattnnnnnntttgngncgncgtcgctnnngcnntntgngancgntatggtntnnnnaannantncncnannntnnttnnnncnnttcnnnnnatgntnnnanannannnnaanttcnannnnctnttnnatgaaccgctcgcttgtnnnnnnnnngganannnnatnnnnnanacnntcnnnaganntnnnnntganttngctttgggtaatcatgtttaanctaatnnnntntctnncatannnnnnnntnnnnnncttnccnttnnnntnnnnntncttttntnttnnctnncnntncnnnnnnnntnnttnntnnnnnngnnganntnntntnnnncnnnnctnancncnnngnnnaannnnanntttttntnanaannttnatcctgttttgaantcnnnnnnnnntnnnnntnttnnnccnnncatnntnnnccngnnttngnattttcaagtttagacccnnaatgtntnnnncaaattnnnnancgnnnanntnnttggtnnntncanggttgtnnacttcctncnncntntntnnnnnnananntntgnntnctngnnnnnnnnntcnnntnnannnnangnnnnnnntgtntntcnnnntnnnacncncanaancntnnnntnnnnaanntnnnnncnntncaantnnncattnnnncnnnaancnntnnnacnnnnnnaacnnannnnnnnnnnnnnnnaagnnnnnnnnnaactnnnnaatanatnngannnnnnnnnntnttnnnnnanttnntnntntanngnnannnnngnttatattctttgctaccaaaaatttgtntanannattntnnnaannntnnnnnnnnnttnnnnnnaannntnnnannnnnnnnnncnnntgnntaatttnnnnnctgtnnnnntnnnnnnncnnnntgacgacgtttgtttcgtcgaactcgcacatgactcnntnnnatnnnntgncannnnanannntttnnnnnnnntnnncnnnntntnntnnnnnnntcagtcacttctcatttataatgttacgtctaananttnccnnnnnnantncgnnantngatttcacgaccnttttnnannngntcctnnnnnnnnncnnnannannnnnnnntnnnnnnnnngnntnnnnnnangancnanntnnnnngcacccntngagttatcgataaggttggaggntnnnntnnnntgacntnnnnngnncttnnnnnttnnnnnnntcntntnntnntcnncnnncnnnnntnnctnnnnantnacgnncncnnntncnnnnntatantgggnnntnccgntgtggccgcctcatctagcccatttcgcattatatctaattnnanntnnnnnctnantnnnnnnatcctttnnnnnntattnnannntttnnnnnncnnnntnnnatacctccttgaannttnannnnnnntnnnntnnntnnnnncntnnaattnntnnnnaancnnnnnnnnantntnnntnnnannnntntnnnnnnntattcgactaatattaattccaaaattaatacaaccntatatgncnnantnntacagtgcgnnnntnnnttgttnnntnnnntnttnnattntntnncgcnnnnnngtnatttnnttnncnnncntcnnntntttntnttntnnnnnannnnnaaaagataagtaaatnnnnnnntnnnttanttccatatnatntnnatnnntntnntnnnnntantnnnnctattttantncntntnnannnnntnntnncnnacnnancnaannngnnnnnnngnnnntnnctgncncnnntnnnncnannnnccanaanncnnntgnncnnnnnnncnnncnaacgcgagttnctgctncgnnnaaatcnnnnncngnannncnnanncnnnnnnnnantangnnngnnannanctccgtcatttccgacatctcgnnnnnntnnnntnannnnnnnnnccnnnctntngnttnnnnngntgntntntncgtcgttgccctcgtcntcanccannacnnttantnntnntnnnnnnnnnnnnnnnannnnnnngnngnaannntcgtgaagttcgtgacaaacttcgtcactcagttttcatcctttaagtctagtaagtgcaccattntnnnntngntnnnnnntnnngtncnnantntncanannnnnntnnnnnnnnntnnnctcgnnnnntttnttnnngntnnnnnnnacncnnncgnnaannnnnnnntnnnnnnnncncncnnntnatnnnnnnngntnatnnttatnccngcnntntntanntnnnnntntgtcatccangcnnnntnacntcnnnnnnnntnnnntgtnacantnnngtnntnccntntnnttcnnnnnnnnnnnnnnnntcagtanncnnnannngnnntncnntncttttnnnnncacannnntttnntgcnnaangtntctcannngtnatnnnntntnnngtccnntanccnncnnnnaannnncggtnntgnaggcgctcgctctgcattcgtacttccgtgtgaggctccagcagtcacgactttncannnnnnnnnnnntnnntttcntgnacngnatnnnnnttcttantntnttgnantnnnnnnnnnaannggtnnnnnngnatagnnnnncncnncannnnntnnagnnnnnncncnnnnnncnantggnnnnnnccccnngtcttnnggagntgtagncngtccttnngncanngncncccttgnatnacnnnnnnnctnannnntggtgaactcnnnctcttggagacgtaaccacttnaagctccttcctnnntnntngagcatcgctgcgatttgccgccgcgtcaagtaatttctttcttnnannnnntnnnntatttnnnnntnnannttnttataactcccttccgtnanttctttnnttttntnnnnnntngnaaaaaaaaaaaaaaaaaaaaaaaaaaaaaaaaaaaaaaaaaaaaaaa

SEQ ID NO: 2 - DNA, 234 bp, unknown
  unknown virus
ataaaaccatatcacaaaaaattctcaaaaccctcacccggttcaagtatcttgtgttatcgtcattccatcctcacccggtggaataaactaggcttcctaacccggagtcttaaccaggaattcctcacccgaattccaccaaactccaacccttcaccagggtcggaaacaacacacacaactttatcagttgtgcaatccagtttaaccgtgtaataccgttaaacaacc

SEQ ID NO: 3 - DNA, 9538 bp, unknown
  unknown virus
ataaaaccatatcacaaaaaattctcaaaaccctcacccggttcaagtatcttgtgttatcgtcattccatcctcacccggtggaataaactaggcttcctaacccggagtcttaaccaggaattcctcacccgaattccaccaaactccaacccttcaccagggtcggaaacaacacacacaactttatcagttgtgcaatccagtttaaccgtgtaataccgttaaacaaccatgtcttctctgcaagacaaattcggccttgcctcatccgcaaccgccaccatcagcgcatcctcatccgatgtgctacccccgtctgctgctacaggaaaatccctcggcattgatgatttttcgcataactgcgttcttgatcagctcagacaaaacactgccctcgactacgaggacatctccaagaatgttaatagtaacattctcaaacaactcttgacatctccccagactcaagagatcatcgtttctgctatgcttaacgataccgtcgacgctcttaatgccaagaaccgattgacgaaagtcccagtctatcaaagactgagcaaggaggaccaagatcgcctccgaaaaacattttgcatgttcaacctcgacttctccaaagcttacgactgcgccggccatccattctggcgtgcttaccgtactctttctgaacgcaaaatgctccgccaagcgggaattacccctggatcccgtcccgctaaaggttacgatgctgtgtacaaagacgttggtggtaaccccgttacacacctcaaccgaggtgagtgttactgccacacttgcatgccccttctttctaacaatgacgacaaacgtcattccgcttacaaagaaagacttcgccgttactccacacacaagcattctccctgcttcaatttacacctatcccaggactcccgcgtcatttgtaacaggatgtctcaaaattgctccgtgaaatctgaagtcctcattttccttcactccacttacgacatgactctttccgacatcgctgatgccatgcaccgcgctgatgccagaaccgcttatggtgtcatgcacttcaatccctgcgtattgtacgaaaagaaaggcaaactcctcaacggtatgaattttgagaaacgtgtcgtcaacggtcgtatgcgaatcagattttggtacacgaacgacagccaggaaggttacgaacacgacttccttaattatgtcgctctactccgcacattcagaatcgcatctacttcgaaagatacacgctactacaacgtccaatttgacactaccgacgacgacacagccttctttgtaatcagacaatccataagtgggaccattccccgatcccaccctttccgcgtcttcaccaacgaagctctcgctgacaaaatgatcgtctactcatggcattgggacactattaaccctggtaacatttcgtcaagcgtcatatctcgaatgcgcccccaacgtcttatcgttcctcgtaaactcttctacaagatgtgtgccttcgctgatactcttcctgactccaagttcactgtcaaaaacattctcatcgctggtaccagtttcaacacccgtgaagtcatttccggacagtcaattggagtcgtcgacccaatcgaacctgctgaactgaaaatgctcgctgtctgcatctacgtcctcacttacatctcaaattacgagtgcaccaagtctctgtccactatgatagctgatgaagaccgagtccgcgaagaatccagcagcggattcttctcccgattgttccgcttgcacatccgacttccgtggaatcatcgcgttcagaagttccaacagaagatggacagactcattgacgaaatgaaatcgtttgaaccacaactcaccgaagacgaagacctcaccaccagtaacgtaaaaaccatcatcaacggggttaaatcattcgccgccgtcaatcgccggtttgacatcacccttgacaagatgtgtaacttcctaactgttgaagaagaactcgactgtctgtccgttggtgttatcccatgcgatcgcgggttcacttctgattcccccgtctgtgactacattgaccccgagatggtccgtgaagccgtcatcagttcacttgaagatgtgaaagtaaccgagactgtctacgacacttcttcatttgtcaccactgcttgtgtgtctgacctcgcagtcgtcgaaaacaactccaacggagactgcgtcttccaatccatgattgacgcatccgaattgcacgactacgaaccacgtcagattcgcaacagacttctcaccagtacttactttcacaatctgcgcgacgtcgcttcccaacgccgcttacttgaatgcactgacggatcccctgacggttacggagacttatcaaccttcattctttactccttggaattgcaacaaggagtttgcattcacgttaacgggatctctatgcggtttggtgccgcacctttcaagcacttccttattcgtgacaatcattgctcctacctcaggcctacccacaacttcgacgctgttcctacctataaattctccgaagacgtgccacctatcgagtactcaaccgcctcccgtgacaagcaattcgaccaatttttcggacttcgcagtcaatattcacgcagtcagttcaataagcggcttattgctgccaaacataactactgccctcttagtgaattgggagatggaaactacgtctgcagatccggtatgaaaaccgctgaaatgttcgtccgctatttctctactcgtgagtacgagtccgccgtctctatcggtggtcccggtggtgaagtccagtatcttacaaacaaaggtatacgcgtattcggtatcacgaaaaccgacctgattgatttttcaccctcggtcaaacaccaccttttcacacagctcatcggagacacttatgatggtgacatcaccaaggaatgcaatgttgttgcattccgtgattccatccgtaaatgttactcgtctggtgtctgctttttcggtggtgacgtcgccacgtctgaaagcgacagtaatcataactttcccgcacttgcaaagttggtcgcctgggagatcgttctttgcaccactgttcttaagaacggtggtgacgcctacttcaaagtccttgacctgcttagtgaccaaatgccccacaacattgaatttctcaacaattccttcgagtctgtagagattgtgaaactcgaaacttcacgcgccgcctctactgaattgcacctcatttgtcgtgggttcaaactcaccaacgaattgcccgtcgcttgttacgagaacctcatcctcggtgaatcccacgacgtcgccgatgctacaactgtcaacttgatgcacgcacaaaaaatgtttgacgcccacatcatttccgggcttcgcgagtaccgcaagtgtttcaatactgccggtgagaacaacgaacatgtcaaccgattcccagaagaaaaaattgagggatatcgtaatgtcttgtgtctggcttcccgggtgactgccggtggtctcaccgacgctgtcaaacgcacatttcgcaacatttacaccatcgctggtccaagacgtgactatgttgctgaactgcgagacttcgtgtatgatgtccctgccgatgtcagaccggccgccacaaccccacccgtcgtcactccccccgtgttcccctcgagccccgctgaagctgaagaacctctcgaactgcttgtcgccgaacctgcacctggtgtcgtcacgcggatcgtcgagtacatgaagaaaccgaaaattgacaagtttctcgtctcgaccgaacctgacggtactttcacagaaatagggcaaagtaagtctctcgggataaccgcgccgccgccactcgtcttcaatagtgttcccttcaacgtcaaaccaaagtcccacgtacccacacacaaacctgataacccccccgcacccgctgtcgtggaagaagttaccgttgaacacgacgtttgtagagccgccatgaacgaattcgtcgaactccaaaagcttactctatcttgcgagatttcgaaccacgcacgcatgttgcaaaggatctcttccctccctctcgcgaaaacattcaccgaagaggaaaatggaaaatacacgtactgcaccgtcgctatcggtcacgaaatccgttacagattcggaaataaggaagaacgcaaatacaacaagttcttcttcaatggaaaattccatcgcgtcgccgacatgaaacgtatccttagtgtcggggactcgttcctgttttccgaatactgtactatcgctattgaagaggaaatgatcgccgcgtgtgagtctgtcgacgtgtctaagttcgtaatcccacatggaactggtattgtacaagccgctgctggttgtggaaagacgtacttcgttgtcaagaattgtgtaccagctcacatgccatgcgccagcaatgtccttctctccactgtagaaggaaaagaagactttgtgagaagaattgaaaaggaatacaaagttgaattgacatcggaacatcgaatccacatccgcacactggcgagcttcatcgtcaactacaaacgcaacattaaaagtgatacgttgtttattgacgaagcgctcatgtcgcatccgggtcaaatcttctatgccatagccctttccggtgccaccgaagtcaaacttctcggagacgtactgcaaatcccgtatgttaaccgcacccctgcttacactaccaagtatcaccgcctcgctgacttcgtccccatcatcgataccctctacatttcttatcgatgtcctactgacgtcgctgccagactcgactctcattatgccgaactcaacaacaacggatgtggaatgaaatctgtcaagttctctaccaacacctgcaaagttgtgcgattgagcaatgagaacttccctcacgacaagaatgtacagtacctcactttcactcagaatgaaaagaagaaacttgagctgctgcaccttcgcgtttccacaattcacgagtttcaaggtaaagaagcgaaggtcatacgcgtcgtcaggcttaatccattcccccaggaagaactgtttttgcggtttaattacgctctcgttgccctcactcgtcacactgaacagctcacctactacactcgtgtcaccaccgacgcgctctctaagcttattaaggtcgatggtatcacatgtcacgtcgccgtttctgaagacgagtgtcgtcgtgtccatcacattaccgctggtgtcgctgacactgaagtgtttcgaatcgccgagaaccttcccgtcgccacgtacaccactatgagtgtcgtcaagtcgcccatcaccactatcactgaaccacgcctctacttcgtgcctcagttcggaaagaagtcggattgcaaacacaaaccactggtcatgcgatccaacgtcgttgtcgatagttcacgcggtcaactcaatgtctatgtcgtttcctctgtttcccagaaccagaaacacaacctcaccacgattactaagaatctgcgcgaatgcgcacccatccttcatgaacgaggtgtcggacgtatcttcgtgtctggtgccgttgaaactgacatcgaccgcgctgccctcggttataccatgtacaagtcactgagagctaaatcgtacctttgctccaccaatgatgtgtacgatgtgccttccgaggtgttcgaacttctcacacgaaacggcatgaatcctcttccgaattgccagttcgagtcctcaaaattttccaccgccgactatatacctgtccacgatgtccctcatgtgttctctgtctgtaccgctcaaacctttatcaccagtttcttcggaccatgcgctttcactgaccagtcttttgacggttgggacgtacgtaacagcgacctcaacattgaagtcggggaaatctctttctcacccgttggttgcgtacaactaggaaaaacgtttgacacaatgcgtccgattttgcgaacacctatgcctcacatccgtgattacaacactcgcgaactcatgttggctcttgaaaagcgcaaccgcaatgtcccctctatgaacggagtcgtcgacattgaagtgtcatcttctgaaatgctcgactccttgctcgaggaatgcttcgatccagcactgttacgcttccacctcgctgaaccaatcactatatcctcgaactcggtaggtgagtggttgagtggtcagcctctctccgtcagacccatgattgtccccgattttgcattgcactgtcttgcgcttaatgagtacaacttctctattaagcgcaagccgaaacccaacctcaccgttgatgctactgcctcgtatcttgcgttgcagaccatcgtttatcacgaaaagtccatcaacgccatgttttgctccatctttcgtgagatcaagaaacgcgttacctcttctcttttgcctcacgtaaaaatcttctgcgatatgtcttccgaggatttcgaagaagtgctccaacgtgacattcccccgtccaaactttctgctgtttgcgataagttagagatcgacattagtaaatacgacaagagtcaacgcgaacttgctctcgagttcgagtgtaaactcatgctgcgttttggagtcgctccggacatcgtcgagctgtggttcaatgcacatgtgcttacgcgtgtgtatgacaagaccaccaaattgaaagcactggtctcgtatcaacgcaagtcaggagacgcttccactttcatagggaacacgctgttcttgatggccgtggtttgcgatctcatccctgtttctcaattggagctcgccttgttttctggtgatgactcactcctttacggacattcgctctcgcagtttaagaacgcacagcatttcggactcaagttcaacctcgagatcaaatttttcgagtttgacaagtcgtacttctgctcaaagttcttactcgtcgtcaacgaccattggacttttacccctgatccactaaaattcatcaccaaacttggtagacacgacctcgtcaatccccttcacgtagaggaataccgcatttcatttgttgacaccgtcaaaaactacaagaactacgcagtttgcgtcgccgtcgctgatgcattgtgcgaacggtacggtgtgttcaaaaacttcacgaacttccttgcctcgcttccgaacatgaccgatgaacgcaatttcaaccagctgttctattctgaactgggagaccgtattgatcacacagtcgttttcagtcgtgatttctaatctaatcacttgtcttccatagtaaaccatcatgcgcctcccgtttctgttcgtttgccttttcttcaccgccgagtgcgctgttttcagcagcgatgttgtcaaccagctctcaacacggcgagaaaaactcgctttttatcagaaatttcatcctgttttgaaatccctcggtcgtcatcgtatttctccgtacatgttcgaccggtcttgcctcaatgtctaccgcacaaacgattatttgtttggtgagtgcacccttccacctaattgttccgagccatctgtcatcaagctcgacaaaacattttacggtcaggaaaccgttgtctgtcactcttcaaccctgaaagacaaatcgagggaattcgagttcttcaacatctcattcactccccgaccggtcgcactccgcgaacctatcactctttacggtaaagtgtttactcaacttaagaatatgaaaccagtatccttctttgagtggtactatatcgtaaagtccgacgacaacatgttcggaattgtaccgcgtatttgtgacgaacttttccatcactcctcccgtctgcccaaaactgtgcgcattgaacatcgtggtgacgacgtttgtttcgtcgaactcgcacatgactctcttcaatgtgatcccatcctttttcccagtctgcccgtacttttcactatccacgacttccctatcgagttcgacggtgctccattttcacagggttctttcgcttccaccaataacaaagttatgggagcggacgcttactctacgaacaacctcacacgcacccctcgagttatcgataaggttggaggttcgtatatggtgacttacgatgcacttgactattccggacctcgtttcattgtccgcagtcatagttacctccctaccgacaaaccctattgcttccaccttgccgcacattacacttctccgctttctaacatcctctccaacgtgtccaagttttttcgtaacgaattggaatacctccttgaatttttaaaagaaatcgccgccgatcttgcatttattttgttcaagatcataagcgaaatcttcgacatcatcatgtcgtttgtaccttacaactctcacttttacagtgcgctgtttgtttgttccttcacgtatttgatgttgcgcgacctcgtcatttctttggcagtcctcgtcgctgtttattgtgtaaaaatctactcagattcttccatataatgtgtattcatcttcttctcctaatcgtactaatttactacttgtacaatgtctgctgccccccgaaagcaatctgcaggcaggactgtggctgccgcccgttccaccacttcccagaaggctgctgtccctactgcttcgaagaaatcaaccccgtcaaagcggaaccgatcgaacactatgttcgatcttaactccgtcatttccgacatctcgtcaacattcactaagggtcttaaccgacctctagtcttgctgagtgtcgtttgcgtcgttgccctcgtcgtcacccacaacgctgacttctcctccggagttgtcggcaagtggatcgccgaaaagtccgcttccaactcccttgcactctgggtccaccagaaccaggtgcggtttcttggactcgccgtttttcttcccgccgttctcgacacgcccgacaacgtccgcgtcgccgtagctctcgcctcatgtttctgggtgatgcttattcccgcagtctctatttatgaatatgtcatccaagctctcgcacttcacacttacttccgtgtgacactgcagaactcccgcatcttcatcctcctggctgtcggtgtgctctactttttcgggcacatcacccttagcccacccccgacacctggtgctcttgcaccgaattcaacttccgcatagacgaactccacaggagatgtagtctgcacactctgtgccattggtgaactcccttctggagatgtagccagtccttatgacacccttgcatcactttgatgctaactcatggtgaactcctcttggagacgtaaccactttaagctccttccgagcatcgctgcgatttgccgccgcgtcaagtaatttcttggaaaacccttaaatttttctaaattcactctctttacttctttctcttttacctaattggcaaaaaaaaaaaaaaaaaaaaaaaaaaaaaaaaaa

SEQ ID NO: 4 - DNA, 7107 bp, unknown
  unknown virus
  CDS (1)..(7107)
atgtcttctctgcaagacaaattcggccttgcctcatccgcaaccgccaccatcagcgcatcctcatccgatgtgctacccccgtctgctgctacaggaaaatccctcggcattgatgatttttcgcataactgcgttcttgatcagctcagacaaaacactgccctcgactacgaggacatctccaagaatgttaatagtaacattctcaaacaactcttgacatctccccagactcaagagatcatcgtttctgctatgcttaacgataccgtcgacgctcttaatgccaagaaccgattgacgaaagtcccagtctatcaaagactgagcaaggaggaccaagatcgcctccgaaaaacattttgcatgttcaacctcgacttctccaaagcttacgactgcgccggccatccattctggcgtgcttaccgtactctttctgaacgcaaaatgctccgccaagcgggaattacccctggatcccgtcccgctaaaggttacgatgctgtgtacaaagacgttggtggtaaccccgttacacacctcaaccgaggtgagtgttactgccacacttgcatgccccttctttctaacaatgacgacaaacgtcattccgcttacaaagaaagacttcgccgttactccacacacaagcattctccctgcttcaatttacacctatcccaggactcccgcgtcatttgtaacaggatgtctcaaaattgctccgtgaaatctgaagtcctcattttccttcactccacttacgacatgactctttccgacatcgctgatgccatgcaccgcgctgatgccagaaccgcttatggtgtcatgcacttcaatccctgcgtattgtacgaaaagaaaggcaaactcctcaacggtatgaattttgagaaacgtgtcgtcaacggtcgtatgcgaatcagattttggtacacgaacgacagccaggaaggttacgaacacgacttccttaattatgtcgctctactccgcacattcagaatcgcatctacttcgaaagatacacgctactacaacgtccaatttgacactaccgacgacgacacagccttctttgtaatcagacaatccataagtgggaccattccccgatcccaccctttccgcgtcttcaccaacgaagctctcgctgacaaaatgatcgtctactcatggcattgggacactattaaccctggtaacatttcgtcaagcgtcatatctcgaatgcgcccccaacgtcttatcgttcctcgtaaactcttctacaagatgtgtgccttcgctgatactcttcctgactccaagttcactgtcaaaaacattctcatcgctggtaccagtttcaacacccgtgaagtcatttccggacagtcaattggagtcgtcgacccaatcgaacctgctgaactgaaaatgctcgctgtctgcatctacgtcctcacttacatctcaaattacgagtgcaccaagtctctgtccactatgatagctgatgaagaccgagtccgcgaagaatccagcagcggattcttctcccgattgttccgcttgcacatccgacttccgtggaatcatcgcgttcagaagttccaacagaagatggacagactcattgacgaaatgaaatcgtttgaaccacaactcaccgaagacgaagacctcaccaccagtaacgtaaaaaccatcatcaacggggttaaatcattcgccgccgtcaatcgccggtttgacatcacccttgacaagatgtgtaacttcctaactgttgaagaagaactcgactgtctgtccgttggtgttatcccatgcgatcgcgggttcacttctgattcccccgtctgtgactacattgaccccgagatggtccgtgaagccgtcatcagttcacttgaagatgtgaaagtaaccgagactgtctacgacacttcttcatttgtcaccactgcttgtgtgtctgacctcgcagtcgtcgaaaacaactccaacggagactgcgtcttccaatccatgattgacgcatccgaattgcacgactacgaaccacgtcagattcgcaacagacttctcaccagtacttactttcacaatctgcgcgacgtcgcttcccaacgccgcttacttgaatgcactgacggatcccctgacggttacggagacttatcaaccttcattctttactccttggaattgcaacaaggagtttgcattcacgttaacgggatctctatgcggtttggtgccgcacctttcaagcacttccttattcgtgacaatcattgctcctacctcaggcctacccacaacttcgacgctgttcctacctataaattctccgaagacgtgccacctatcgagtactcaaccgcctcccgtgacaagcaattcgaccaatttttcggacttcgcagtcaatattcacgcagtcagttcaataagcggcttattgctgccaaacataactactgccctcttagtgaattgggagatggaaactacgtctgcagatccggtatgaaaaccgctgaaatgttcgtccgctatttctctactcgtgagtacgagtccgccgtctctatcggtggtcccggtggtgaagtccagtatcttacaaacaaaggtatacgcgtattcggtatcacgaaaaccgacctgattgatttttcaccctcggtcaaacaccaccttttcacacagctcatcggagacacttatgatggtgacatcaccaaggaatgcaatgttgttgcattccgtgattccatccgtaaatgttactcgtctggtgtctgctttttcggtggtgacgtcgccacgtctgaaagcgacagtaatcataactttcccgcacttgcaaagttggtcgcctgggagatcgttctttgcaccactgttcttaagaacggtggtgacgcctacttcaaagtccttgacctgcttagtgaccaaatgccccacaacattgaatttctcaacaattccttcgagtctgtagagattgtgaaactcgaaacttcacgcgccgcctctactgaattgcacctcatttgtcgtgggttcaaactcaccaacgaattgcccgtcgcttgttacgagaacctcatcctcggtgaatcccacgacgtcgccgatgctacaactgtcaacttgatgcacgcacaaaaaatgtttgacgcccacatcatttccgggcttcgcgagtaccgcaagtgtttcaatactgccggtgagaacaacgaacatgtcaaccgattcccagaagaaaaaattgagggatatcgtaatgtcttgtgtctggcttcccgggtgactgccggtggtctcaccgacgctgtcaaacgcacatttcgcaacatttacaccatcgctggtccaagacgtgactatgttgctgaactgcgagacttcgtgtatgatgtccctgccgatgtcagaccggccgccacaaccccacccgtcgtcactccccccgtgttcccctcgagccccgctgaagctgaagaacctctcgaactgcttgtcgccgaacctgcacctggtgtcgtcacgcggatcgtcgagtacatgaagaaaccgaaaattgacaagtttctcgtctcgaccgaacctgacggtactttcacagaaatagggcaaagtaagtctctcgggataaccgcgccgccgccactcgtcttcaatagtgttcccttcaacgtcaaaccaaagtcccacgtacccacacacaaacctgataacccccccgcacccgctgtcgtggaagaagttaccgttgaacacgacgtttgtagagccgccatgaacgaattcgtcgaactccaaaagcttactctatcttgcgagatttcgaaccacgcacgcatgttgcaaaggatctcttccctccctctcgcgaaaacattcaccgaagaggaaaatggaaaatacacgtactgcaccgtcgctatcggtcacgaaatccgttacagattcggaaataaggaagaacgcaaatacaacaagttcttcttcaatggaaaattccatcgcgtcgccgacatgaaacgtatccttagtgtcggggactcgttcctgttttccgaatactgtactatcgctattgaagaggaaatgatcgccgcgtgtgagtctgtcgacgtgtctaagttcgtaatcccacatggaactggtattgtacaagccgctgctggttgtggaaagacgtacttcgttgtcaagaattgtgtaccagctcacatgccatgcgccagcaatgtccttctctccactgtagaaggaaaagaagactttgtgagaagaattgaaaaggaatacaaagttgaattgacatcggaacatcgaatccacatccgcacactggcgagcttcatcgtcaactacaaacgcaacattaaaagtgatacgttgtttattgacgaagcgctcatgtcgcatccgggtcaaatcttctatgccatagccctttccggtgccaccgaagtcaaacttctcggagacgtactgcaaatcccgtatgttaaccgcacccctgcttacactaccaagtatcaccgcctcgctgacttcgtccccatcatcgataccctctacatttcttatcgatgtcctactgacgtcgctgccagactcgactctcattatgccgaactcaacaacaacggatgtggaatgaaatctgtcaagttctctaccaacacctgcaaagttgtgcgattgagcaatgagaacttccctcacgacaagaatgtacagtacctcactttcactcagaatgaaaagaagaaacttgagctgctgcaccttcgcgtttccacaattcacgagtttcaaggtaaagaagcgaaggtcatacgcgtcgtcaggcttaatccattcccccaggaagaactgtttttgcggtttaattacgctctcgttgccctcactcgtcacactgaacagctcacctactacactcgtgtcaccaccgacgcgctctctaagcttattaaggtcgatggtatcacatgtcacgtcgccgtttctgaagacgagtgtcgtcgtgtccatcacattaccgctggtgtcgctgacactgaagtgtttcgaatcgccgagaaccttcccgtcgccacgtacaccactatgagtgtcgtcaagtcgcccatcaccactatcactgaaccacgcctctacttcgtgcctcagttcggaaagaagtcggattgcaaacacaaaccactggtcatgcgatccaacgtcgttgtcgatagttcacgcggtcaactcaatgtctatgtcgtttcctctgtttcccagaaccagaaacacaacctcaccacgattactaagaatctgcgcgaatgcgcacccatccttcatgaacgaggtgtcggacgtatcttcgtgtctggtgccgttgaaactgacatcgaccgcgctgccctcggttataccatgtacaagtcactgagagctaaatcgtacctttgctccaccaatgatgtgtacgatgtgccttccgaggtgttcgaacttctcacacgaaacggcatgaatcctcttccgaattgccagttcgagtcctcaaaattttccaccgccgactatatacctgtccacgatgtccctcatgtgttctctgtctgtaccgctcaaacctttatcaccagtttcttcggaccatgcgctttcactgaccagtcttttgacggttgggacgtacgtaacagcgacctcaacattgaagtcggggaaatctctttctcacccgttggttgcgtacaactaggaaaaacgtttgacacaatgcgtccgattttgcgaacacctatgcctcacatccgtgattacaacactcgcgaactcatgttggctcttgaaaagcgcaaccgcaatgtcccctctatgaacggagtcgtcgacattgaagtgtcatcttctgaaatgctcgactccttgctcgaggaatgcttcgatccagcactgttacgcttccacctcgctgaaccaatcactatatcctcgaactcggtaggtgagtggttgagtggtcagcctctctccgtcagacccatgattgtccccgattttgcattgcactgtcttgcgcttaatgagtacaacttctctattaagcgcaagccgaaacccaacctcaccgttgatgctactgcctcgtatcttgcgttgcagaccatcgtttatcacgaaaagtccatcaacgccatgttttgctccatctttcgtgagatcaagaaacgcgttacctcttctcttttgcctcacgtaaaaatcttctgcgatatgtcttccgaggatttcgaagaagtgctccaacgtgacattcccccgtccaaactttctgctgtttgcgataagttagagatcgacattagtaaatacgacaagagtcaacgcgaacttgctctcgagttcgagtgtaaactcatgctgcgttttggagtcgctccggacatcgtcgagctgtggttcaatgcacatgtgcttacgcgtgtgtatgacaagaccaccaaattgaaagcactggtctcgtatcaacgcaagtcaggagacgcttccactttcatagggaacacgctgttcttgatggccgtggtttgcgatctcatccctgtttctcaattggagctcgccttgttttctggtgatgactcactcctttacggacattcgctctcgcagtttaagaacgcacagcatttcggactcaagttcaacctcgagatcaaatttttcgagtttgacaagtcgtacttctgctcaaagttcttactcgtcgtcaacgaccattggacttttacccctgatccactaaaattcatcaccaaacttggtagacacgacctcgtcaatccccttcacgtagaggaataccgcatttcatttgttgacaccgtcaaaaactacaagaactacgcagtttgcgtcgccgtcgctgatgcattgtgcgaacggtacggtgtgttcaaaaacttcacgaacttccttgcctcgcttccgaacatgaccgatgaacgcaatttcaaccagctgttctattctgaactgggagaccgtattgatcacacagtcgttttcagtcgtgatttctaa

SEQ ID NO: 5 - protein, 2368 aa, unknown
  Synthetic Construct
MSSLQDKFGLASSATATISASSSDVLPPSAATGKSLGIDDFSHNCVLDQLRQNTALDYEDISKNVNSNILKQLLTSPQTQEIIVSAMLNDTVDALNAKNRLTKVPVYQRLSKEDQDRLRKTFCMFNLDFSKAYDCAGHPFWRAYRTLSERKMLRQAGITPGSRPAKGYDAVYKDVGGNPVTHLNRGECYCHTCMPLLSNNDDKRHSAYKERLRRYSTHKHSPCFNLHLSQDSRVICNRMSQNCSVKSEVLIFLHSTYDMTLSDIADAMHRADARTAYGVMHFNPCVLYEKKGKLLNGMNFEKRVVNGRMRIRFWYTNDSQEGYEHDFLNYVALLRTFRIASTSKDTRYYNVQFDTTDDDTAFFVIRQSISGTIPRSHPFRVFTNEALADKMIVYSWHWDTINPGNISSSVISRMRPQRLIVPRKLFYKMCAFADTLPDSKFTVKNILIAGTSFNTREVISGQSIGVVDPIEPAELKMLAVCIYVLTYISNYECTKSLSTMIADEDRVREESSSGFFSRLFRLHIRLPWNHRVQKFQQKMDRLIDEMKSFEPQLTEDEDLTTSNVKTIINGVKSFAAVNRRFDITLDKMCNFLTVEEELDCLSVGVIPCDRGFTSDSPVCDYIDPEMVREAVISSLEDVKVTETVYDTSSFVTTACVSDLAVVENNSNGDCVFQSMIDASELHDYEPRQIRNRLLTSTYFHNLRDVASQRRLLECTDGSPDGYGDLSTFILYSLELQQGVCIHVNGISMRFGAAPFKHFLIRDNHCSYLRPTHNFDAVPTYKFSEDVPPIEYSTASRDKQFDQFFGLRSQYSRSQFNKRLIAAKHNYCPLSELGDGNYVCRSGMKTAEMFVRYFSTREYESAVSIGGPGGEVQYLTNKGIRVFGITKTDLIDFSPSVKHHLFTQLIGDTYDGDITKECNVVAFRDSIRKCYSSGVCFFGGDVATSESDSNHNFPALAKLVAWEIVLCTTVLKNGGDAYFKVLDLLSDQMPHNIEFLNNSFESVEIVKLETSRAASTELHLICRGFKLTNELPVACYENLILGESHDVADATTVNLMHAQKMFDAHIISGLREYRKCFNTAGENNEHVNRFPEEKIEGYRNVLCLASRVTAGGLTDAVKRTFRNIYTIAGPRRDYVAELRDFVYDVPADVRPAATTPPVVTPPVFPSSPAEAEEPLELLVAEPAPGVVTRIVEYMKKPKIDKFLVSTEPDGTFTEIGQSKSLGITAPPPLVFNSVPFNVKPKSHVPTHKPDNPPAPAVVEEVTVEHDVCRAAMNEFVELQKLTLSCEISNHARMLQRISSLPLAKTFTEEENGKYTYCTVAIGHEIRYRFGNKEERKYNKFFFNGKFHRVADMKRILSVGDSFLFSEYCTIAIEEEMIAACESVDVSKFVIPHGTGIVQAAAGCGKTYFVVKNCVPAHMPCASNVLLSTVEGKEDFVRRIEKEYKVELTSEHRIHIRTLASFIVNYKRNIKSDTLFIDEALMSHPGQIFYAIALSGATEVKLLGDVLQIPYVNRTPAYTTKYHRLADFVPIIDTLYISYRCPTDVAARLDSHYAELNNNGCGMKSVKFSTNTCKVVRLSNENFPHDKNVQYLTFTQNEKKKLELLHLRVSTIHEFQGKEAKVIRVVRLNPFPQEELFLRFNYALVALTRHTEQLTYYTRVTTDALSKLIKVDGITCHVAVSEDECRRVHHITAGVADTEVFRIAENLPVATYTTMSVVKSPITTITEPRLYFVPQFGKKSDCKHKPLVMRSNVVVDSSRGQLNVYVVSSVSQNQKHNLTTITKNLRECAPILHERGVGRIFVSGAVETDIDRAALGYTMYKSLRAKSYLCSTNDVYDVPSEVFELLTRNGMNPLPNCQFESSKFSTADYIPVHDVPHVFSVCTAQTFITSFFGPCAFTDQSFDGWDVRNSDLNIEVGEISFSPVGCVQLGKTFDTMRPILRTPMPHIRDYNTRELMLALEKRNRNVPSMNGVVDIEVSSSEMLDSLLEECFDPALLRFHLAEPITISSNSVGEWLSGQPLSVRPMIVPDFALHCLALNEYNFSIKRKPKPNLTVDATASYLALQTIVYHEKSINAMFCSIFREIKKRVTSSLLPHVKIFCDMSSEDFEEVLQRDIPPSKLSAVCDKLEIDISKYDKSQRELALEFECKLMLRFGVAPDIVELWFNAHVLTRVYDKTTKLKALVSYQRKSGDASTFIGNTLFLMAVVCDLIPVSQLELALFSGDDSLLYGHSLSQFKNAQHFGLKFNLEIKFFEFDKSYFCSKFLLVVNDHWTFTPDPLKFITKLGRHDLVNPLHVEEYRISFVDTVKNYKNYAVCVAVADALCERYGVFKNFTNFLASLPNMTDERNFNQLFYSELGDRIDHTVVFSRDF

SEQ ID NO: 6 - DNA, 9532 bp, unknown
  unknown virus
ataaaaccatatcacaaaaattctcaaaccctcacccggttcaagtatcttgtgttatcgtcattccatcctcacccggtggaataaactaggcttcctaacccggagtcttaaccaggaattcctcacccgaattccaccaaactccaacccttcaccagggtcggaaacaacacacacaactttatcagttgtgcaatccagtttaaccgtgtaataccgttaaacaaccatgtcttctctgcaagacaaattcggccttgcctcatccgcaaccgccaccatcagcgcatcctcatccgatgtgctacccccgtctgctgctacaggaaaatccctcggcattgatgatttttcgcataactgcgttcttgatcagctcagacaaaacactgccctcgactacgaggacatctccaagaatgttaatagtaacattctcaaacaactcttgacatctccccagactcaagagatcatcgtttctgctatgcttaacgataccgtcgacgctcttaatgccaagaaccgattgacgaaagtcccagtctatcaaagactgagcaaggaggaccaagatcgcctccgaaaaacattttgcatgttcaacctcgacttctccaaagcttacgactgcgccggccatccattctggcgtgcttaccgtactctttctgaacgcaaaatgctccgccaagcgggaattacccctggatcccgtcccgctaaaggttacgatgctgtgtacaaagacgttggtggtaaccccgttacacacctcaaccgaggtgagtgttactgccacacttgcatgccccttctttctaacaatgacgacaaacgtcattccgcttacaaagaaagacttcgccgttactccacacacaagcattctccctgcttcaatttacacctatcccaggactcccgcgtcatttgtaacaggatgtctcaaaattgctccgtgaaatctgaagtcctcattttccttcactccacttacgacatgactctttccgacatcgctgatgccatgcaccgcgctgatgccagaaccgcttatggtgtcatgcacttcaatccctgcgtattgtacgaaaagaaaggcaaactcctcaacggtatgaattttgagaaacgtgtcgtcaacggtcgtatgcgaatcagattttggtacacgaacgacagccaggaaggttacgaacacgacttccttaattatgtcgctctactccgcacattcagaatcgcatctacttcgaaagatacacgctactacaacgtccaatttgacactaccgacgacgacacagccttctttgtaatcagacaatccataagtgggaccattccccgatcccaccctttccgcgtcttcaccaacgaagctctcgctgacaaaatgatcgtctactcatggcattgggacactattaaccctggtaacatttcgtcaagcgtcatatctcgaatgcgcccccaacgtattatcgttcctcgtaaactcttctacaagatgtgtgccttcgctgatactcttcctgactccaagttcactgtcaaaaacattctcatcgctggtaccagtttcaacacccgtgaagtcatttccggacagtcaattggagtcgtcgacccaatcgaacctgctgaactgaaaatgctcgctgtctgcatctacgtcctcacttacatctcaaattacgagtgcaccaagtctctgtccactatgatagctgatgaagaccgagtccgcgaagaatccagcagcggattcttctcccgattgttccgcttgcacatccgacttccgtggaatcatcgcgttcagaagttccaacagaagatggacagactcattgacgaaatgaaatcgtttgaaccacaactcaccgaagacgaagacctcaccaccagtaacgtaaaaaccatcatcaacggggttaaatcattcgccgccgtcaatcgccggtttgacatcacccttgacaagatgtgtaacttcctaactgttgaagaagaactcgactgtctgtccgttggtgttatcccatgcgatcgcgggttcacttctgattcccccgtctgtgactacattgaccccgagatggtccgtgaagccgtcatcagttcacttgaagatgtgaaagtaaccgagactgtctacgacacttcttcatttgtcaccactgcttgtgtgtctgacctcgcagtcgtcgaaaacaactctaacggagactgcgtcttccaatccatgattgacgcatccgaattgcacgactacgaaccacgtcagattcgcaacagacttctcaccagtacttactttcacaatctgcgcgacgtcgcttcccaacgccgcttacttgaatgcactgacggatcccctgacggttacggagacttatcaaccttcattctttactccttggaattgcaacaaggagtttgcattcacgttaacgggatctctatgcggtttggtgccgcacctttcaagcacttccttattcgtgacaatcattgctcctacctcaggcctacccacaacttcgacgctgttcctacctataaattctccgaagacgtgccacctatcgagtactcaaccgcctcccgtgacaagcaattcgaccaatttttcggacttcgcagtcaatattcacgcagtcagttcaataagcggcttattgctgccaaacataactactgccctcttagtgaattgggagatggaaactacgtctgcagatccggtatgaaaaccgctgaaatgttcgtccgctatttctctactcgtgagtacgagtccgccgtctctatcggtggtcccggtggtgaagtccagtatcttacaaacaaaggtatacgcgtattcggtatcacgaaaaccgacctgattgatttttcaccctcggtcaaacaccaccttttcacacagctcatcggagacacttatgatggtgacatcaccaaggaatgcaatgttgttgcattccgtgattccatccgtaaatgttactcgtctggtgtctgctttttcggtggtgacgtcgccacgtctgaaagcgacagtaaccataactttcccgcacttgcaaagttggtcgcctgggagatcgttctttgcaccactgttcttaagaacggtggtgacgcctacttcaaagtccttgacctgcttagtgaccaaatgccccacaacattgaatttctcaacaattccttcgagtctgtagagattgtgaaactcgaaacttcacgcgccgcctctactgaattgcacctcatttgtcgtgggttcaaactcaccaacgaattgcccgtcgcttgttacgagaacctcatcctcggtgaatcccacgacgtcgccgatgctacaactgtcaacttgatgcacgcacaaaaaatgtttgacgcccacatcatttccgggcttcgcgagtaccgcaagtgtttcaatactgccggtgagaacaacgaacatgtcaaccgattcccagaagaaaaaattgagggatatcgtaatgtcttgtgtctggcttcccgggtgactgccggtggtctcaccgacgctgtcaaacgcacatttcgcaacatttacaccatcgctggtccaagacgtgactatgttgctgaactgcgagacttcgtgtatgatgtccctgccgatgtcagaccggccgccacaaccccacccgtcgtcactccccccgtgttcccctcgagccccgctgaagctgaagaacctctcgaactgcttgtcgccgaacctgcacctggtgtcgtcacgcggatcgtcgagtacatgaagaaaccgaaaattgacaagtttctcgtctcgaccgaacctgacggtactttcacagaaatagggcaaagtaagtctctcgggataaccgcgccgccgccgctcgtcttcaatagtgttcccttcaacgtcaaaccaaagtcccacgtacccacacacaaacctgataacccccccgcacccgctgtcgtggaagaagttaccgttgaacacgacgtttgtagagccgccatgaacgaattcgtcgaactccaaaagcttactctatcttgcgagatttcgaaccacgcacgcatgttgcaaaggatctcttccctccctctcgcgaaaacattcaccgaagaggaaaatggaaaatacacgtactgcaccgtcgctatcggtcacgaaatccgttacagattcggaaataaggaagaacgcaaatacaacaagttcttcttcaatggaaaattccatcgcgtcgccgacatgaaacgtatccttagtgtcggggactcattcctgttttccgaatactgtactatcgctattgaagaggaaatgatcgccgcgtgtgagtctgtcgacgtgtctaagttcgtaatcccacatggaactggtattgtacaagccgctgctggttgtggaaagacgtacttcgttgtcaagaattgtgtaccagctcacatgccatgcgccagcaatgtccttctctccactgtagaaggaaaagaagactttgtgagaagaattgaaaaggaatacaaagttgaattgacatcggaacatcgaatccacatccgcacactggcgagcttcatcgtcaactacaaacgcaacattaaaagtgatacgttgtttattgacgaagcgctcatgtcgcatccgggtcaaatcttctatgccatagccctttccggtgccaccgaagtcaaacttctcggagacgtactgcaaatcccgtatgttaaccgcacccctgcttacactaccaagtatcaccgcctcgctgacttcgtccccatcatcgataccctctacatttcttatcgatgtcctactgacgtcgctgccagactcgactctcattatgccgaactcaacaacaacggatgtggaatgaaatctgtcaagttctctaccaacacctgcaaagttgtgcgattgagcaatgagaacttccctcacgacaagaatgtacagtacctcactttcactcagaatgaaaagaagaaacttgagctgctgcaccttcgcgtttccacaattcacgagtttcaaggtaaagaagcgaaggtcatacgcgtcgtcaggcttaatccattcccccaggaagaactgtttttgcggtttaattacgctcttgttgccctcactcgtcacactgaacagctcacctactacactcgtgtcaccaccgacgcgctctctaagcttattaaggtcgatggtatcacatgtcacgtcgccgtttctgaagacgagtgtcgtcgtgtccatcacattaccgctggtgtcgctgacactgaagtgtttcgaatcgccgagaaccttcccgtcgccacgtacaccactatgagtgtcgtcaagtcgcccatcaccactatcactgaaccacgcctctacttcgtgcctcagttcggaaagaagtcggattgcaaacacaaaccactggtcatgcgatccaacgtcgttgtcgatagttcacgcggtcaactcaatgtctatgtcgtttcctctgtttcccagaaccagaaacacaacctcaccacgattactaagaatctgcgcgaatgcgcacccatccttcatgaacgaggtgtcggacgtatcttcgtgtctggtgccgttgaaactgacatcgaccgcgctgccctcggttataccatgtacaagtcactgagagctaaatcgtacctttgctccaccaatgatgtgtacgatgtgccttccgaggtgttcgaacttctcacacgaaacggcatgaatcctcttccgaattgccagttcgagtcctcaaaattttccaccgccgactatatacctgtccacgatgtccctcatgtgttctctgtctgtaccgctcaaacctttatcaccagtttcttcggaccatgcgctttcactgaccagtcttttgacggttgggacgtacgtaacagcgacctcaacattgaagtcggggaaatctctttctcacccgttggttgcgtacaactaggaaaaacgtttgacacaatgcgtccgattttgcgaacacctatgcctcacatccgtgattacaacactcgcgaactcatgttggctcttgaaaagcgcaaccgcaatgtcccctctatgaacggagtcgtcgacattgaagtgtcatcttctgaaatgctcgactccttgctcgaggaatgcttcgatccagcactgttacgcttccacctcgctgaaccaatcactatatcctcgaactcggtaggtgagtggttgagtggtcagcctctctccgtcagacccatgattgtccccgattttgcattgcactgtcttgcgcttaatgagtacaacttctctattaagcgcaagccgaaacccaacctcaccgttgatgctactgcctcgtatcttgcgttgcagaccatcgtttatcacgaaaagtccatcaacgccatgttttgctccatctttcgtgagatcaagaaacgcgttacctcttctcttttgcctcacgtaaaaatcttctgcgatatgtcttccgaggatttcgaagaagtgctccaacgtgacattcccccgtccaaactttctgctgtttgcgataagttagagatcgacattagtaaatacgacaagagtcaacgcgaacttgctctcgagttcgagtgtaaactcatgctgcgttttggagtcgctccggacatcgtcgagctgtggttcaatgcacatgtgcttacgcgtgtgtatgacaagaccaccaaattgaaagcactggtctcgtatcaacgcaagtcaggagacgcttccactttcatagggaacacgctgttcttgatggccgtggtttgcgatctcatccctgtttctcaattggagctcgccttgttttctggtgatgactcactcctttacggacattcgctctcgcagtttaagaacgcacagcatttcggactcaagttcaacctcgagatcaaatttttcgagtttgacaagtcgtacttctgctcaaagttcttactcgtcgtcaacgaccattggacttttacccctgatccactaaaattcatcaccaaacttggtagacacgatctcgtcaatccccttcacgtagaggaataccgcatttcatttgttgacaccgtcaaaaactacaagaactacgcagtttgcgtcgccgtcgctgatgcattgtgcgaacggtacggtgtgttcaaaaacttcacgaacttccttgcctcgcttccgaacatgaccgatgaacgcaatttcaaccagctgttctattctgaactgggagaccgtattgatcacacagtcgttttcagtcgtgatttctaatctaatcacttgtcttccatagtaaaccatcatgcgcctcccgtttctgttcgtttgccttttcttcaccgccgagtgcgctgttttcagcagcgatgttgtcaaccagctctcaacacggcgagaaaaactcgctttttatcagaaatttcatcctgttttgaaatccctcggtcgtcatcgtatttctccgtacatgttcgaccggtcttgcctcaatgtctaccgcacaaacgattatttgtttggtgagtgcacccttccacctaattgttccgagccatctgtcatcaagctcgacaaaacattttacggtcaggaaaccgttgtctgtcactcttcaacccttaaagacaaatcgagggaattcgagttcttcaacatctcattcactccccgaccggtcgcactccgcgaacctatcactctttacggtaaagtgttcactcaacttaagaatatgaaaccagtatccttctttgagtggtactatatcgtaaagtccgacgacaacatgttcggaattgtaccgcgtatttgtgacgaacttttccatcactcctcccgtctgcccaaaactgtgcgcattgagcatcgtggtgacgacgtttgtttcgtcgaactcgcacatgactctcttcaatgtgatcccatcctttttcccagtctgcccgtacttttcactatccacgacttccctatcgagttcgacggtgctccattttcacagggttctttcgcttccaccaataacaaagttatgggagcggacgcttactctacgaacaacctcacacgcacccctcgagttatcgataaggttggaggttcgtatatggtgacttacgatgcacttgactattccggacctcgtttcattgtccgcagtcatagttacctccctaccgacaaaccctattgcttccaccttgccgcacattacacttctccgctttctaacatcctctccaacgtgtccaagttttttcgtaacgaattggaatacctccttgaatttttaaaagaaatcgccgccgatcttgcatttattttgttcaagatcataagcgaaatcttcgacatcatcatgtcgtttgtaccttacaactctcacttctacagtgcgctgtttgtttgttccttcacgtatttgatgttgcgcgacctcgtcatttctttggcagtcctcgtcgctgtttattgtgtaaaaatctactcagattcttccatataatgtgtattcatcttcttctcctaatcgtactaatttactacttgtacaatgtctgctgccccccgaaagcaatctgcaggcaggactgtggctgccgcccgttccaccacttcccagaaggctgctgtccctactgcttcgaagaaatcaaccccgtcaaagcggaaccgatcgaacactatgttcgatcttaactccgtcatttccgacatctcgtcaacattcactaagggtcttaaccgacctctagtcttgctgagtgtcgtttgcgtcgttgccctcgtcgtcacccacaacgctgacttctcctccggagttgtcggcaagtggatcgccgaaaagtccgcttccaactcccttgcactctgggtccaccagaaccaggtgcggtttcttggactcgccgtttttcttcccgccgttctcgacacgcccgacaacgtccgcgtcgccgtagctctcgcctcatgtttctgggtgatgcttattcccgcagtctctatttatgaatatgtcatccaagctctcgcacttcacacttacttccgtgtgacactgcagaactcccgcatcttcatcctcctggctgtcggtgtgctctactttttcggacacatcacccttagcccacccccgacacctggtgctcttgcaccgaattcaacttccgcatagacgaactccacaggagatgtagtctgcacactctgtgccattggtgaactcccttctggagatgtagccagtccttatgacacccttgcatcactttgatgctaactcatggtgaactcctcttggagacgtaaccactttaagctccttccgagcatcgctgcgatttgccgccgcgtcaagtaatttcttggaaaacccttaaatttttctaaattcactctctttacttctttctcttttacctaattggcaaaaaaaaaaaaaaaaaaaaaaaaaaaaaa

SEQ ID NO: 7 - DNA, 9536 bp, unknown
  unknown virus
ataaaaccatatcacaaaaattctcaagccctcacccggttcaagtatcttgtgttatcgtcattccatcctcacccggtggaataaactaggcttcctaacccggagtcttaaccaggaattcctcacccgaattccaccaaactcctacccctcaccagggtcggaaacaacacacataactttatcagttgtgtaatccagtttaaccgtgtaataccgttaaacaaccatgtcttctctgcaagacaaattcggccttgcctcatccgcaaccgccaccatcagcgcatcctcacccgatgtgctacccccgtctgctgctacaggaaaatccctcggcattgatgattattcgcataattgcgttcttgatcagctcagacaaaacactgccctcgactacgaggacatctcgaagaatgttaacagtaacattctcaaacaactcctgacgtctccccagactcaagagatcatcgtttctgctatgcttaacgataccgtcgacgctcttaatgccaagaaccgattgacgaaagtcccagtctatcaaagactgagcaaggaggaccaagatcgcctccgaaaaacattttgcatgttcaacctcgacttctccaaagcttacgattgcgccggccatccattctggcgtgcttatcgtactctttctgaacgcaaaatgctccgccaagcgggaattacacctgggtcccgtcccgctaaaggttacgatgctgtgtacaaagatgtcggtggtaaccccgttacacacctcactcgaggtgagtgttactgccacacttgcatgccccttctttctaacaatgatgataaacgtcattccgcttacaaagaaagacttcgccgttactccacgcacaagcattctccctgcttcaatttgcatctatcccaggactcccgcgtcatttgtaacaggatgtctcaaaattgttccgtgaaagccgaagtcctcatcttccttcactccacttacgacatgtctctttccgacatcgctgacgctatgcaccgtgctgatgccagaaccgcttatggtgtcatgcacttcaatccctgcgtattgtacgaaaagaaaggtaaactcctcaacggtatgaattttgagaaacgtgttgtcaacggtcgtatgcgaatcaggttttggtacacgaacgacagccaggaaggttacgaacacgacttccttaattatgttgctctactccgcacattcagaattgcatcgacttcgaaagatacacgctactacaacgtccaatttgacactactgacgacgacacagccttctttgtaattagacaatccataagtggaaccattccccgatcccaccctttccgcgtcttcactaacgaagctcttgctgacaagatgatcgtctactcatggcattgggacacgattaaccctggcaacatttcgtcaagtgtcatatctcgaatgcgcccccaacgtatcatcgttcctcgtaaactcttctacaagatgtgtgccttcgctgatactcttcccgactccaagttcactgtcaaaaacattctcatcgctggtaccagtttcaacacccgtgaagttatttccggacagtctattggagtcgtcgacccaatcgaacctgctgaactaaaaatgctcgctgtctgcatctacgtcctcacttacatctcaaattacgagtgtaccaagtctctatctactatgatagctgatgaagaccgagtccgcgaagaatccagcagcggattcttctcccgcttgttccgcttgcacatccgacttccgtggaatcaccgcgttcagaaattccaacaaaagatggacagactcattgacgaaatgaagtcatttgaaccacaactcaccgaagacgaagacctcaccaccagtaatgtaaaaaccatcatcaacggagtcagatcattcgccgtcgtcaaccgccggtttgacatcactcttgacaagatgtgtaacttcctcactgttgaagaagaactcgactgtttgtccgctggtgtcatcccgtgcgatcgcggattcacttctgattcccccgtctgtgattacattgaccccgagatggtccgtgaagccgtcatcagttcacttgaagatgtgaaagtaaccgagactgtctacgatacttcttcattcgttaccactgcttgtgtgtctgacctcgcagtcgtcgaaaacaactctaacggagactgcatcttccaatccatgattgacgcatccgaattgcacgactacgaaccacgtcagattcgcaacagacttctcaccagtacttactttcacaatctacgcgacgttgcttcccaacgccgcttgcttgaatgcactgacggatcccccgacggttacggagacctttcaaccttcattctttactccttggaattacaacaaggagtttgcatccacgttaacgggatctctatgcggtttggcgccgcacctttcaagcactttcttattcgtgacaatcattgttcctacctcaaacctacccacaacttcgatgctattcctacttacaaattctccgaagacgtaccacccatcgagtactcaaccgtctcccgtgacaagcaattcgaccaatttttcgggcttcgcagtcaatattcacgcagtcagttcaataagcggctcattgctgccaaacataactactgccctcttagtgaattgggagatggaaattacgtctgcagatccggtatgaaaactgctgaaatgttcgtccgttatttttctactcgtgagtacgagtctgccgtatctatcggtggtcccggtggtgaagtccagtatcttactaacaaaggtatacgcgtattcggtatcacaaaaaccgacctgatcgatttctcaccctcagtgaaacaccatctcttcacacagctcatcggagacacttatgacggcgacatcaccaaagaatgcaatctcgttgcattccgtgattccatccgtaactgctactcgtctggtgtttgctttttcggtggtgacgtcgccacatctgaaagcgacagtaaccacaactttcccgcacttgcaaagttggtcgcctgggagatcgttctttgcaccactgttcttaagaacggtggtgacgcctacttcaaagtccttgacctgcttagtgaccaaatgccctacaacattgaatttcttaacaattccttcgactctgttgaaattgtgaaactcgaaacttcacgcgccgcctctactgaattgcacctcatttgtcgtggatttaaactcaccaacgaattacctgttgcttgttacgagaaactcatccttggcgaatcccatgacgtcgccgacgcaacaatggtgaacttgatgcacgcacaaaaaatgtttgacgcacacatcatttccgggcttcgcgagtatcgcaagtgttttaatactgccggcgagaacaacgaacatgtcaaccgattccctgaagaaaaaatcgagggatatcgtaatgtcttgtgtctggcttcccgagtaactgccggtggtctcaccgacgctgtcaaacgcacatttcgcaacatttacaccatcgctggtccaaaacgtgactatgttgctgaactgcgagacttcgtgtatgatgttcccgccgatgtcaaaccggtcgccacgaccccgcccgtcgtcactccccccgtgttcccctcaagccccgctgaagctgaagaacctctcgaactacttgtcgccgaacctgcacctagtgtcgtcacgcggatcgtcgagtacatgaagaaaccaaaaattgacaagtttctcgtctcgactgaacctgacggtacttttacagaaatagggcaaagtaaatctctcgggataaccgcgccgccgccgctcgtcttcaatagtgttcccttcaatgtcaaaccaaagtcccacgtgcccacacacaaacctgacaacccctccacgcccgctatcgtggaagaagttaccgtcgaacatgacgtctgcagagccgccatgaacgaattcgtcgaactccagaagcttactctatcttgcgagatttcgaaccacgcacgcattttgcaaaggatctccaccctccctctcgcgaaaacgttcaccgaagaggagaatggaaagtacacgtattgcaccgtcgctatcggtcacgaaatccgtcacagattcggaaataaggaagaacgcaagtacaacaagtttttcttcaatggaaaattccatcgcgtcgccgacatgaaacgtatccttaatgtcggggactcgttcctgttttccgaatactgcactatcgctattgaagaggaaatgatcgccgcgtgcgagtctgtcgacgtgtctaaattcgtaatcccacatggaaccggtattgtacaagccgctgcgggctgtggaaagacgtacttcgttgtcaagaattgtgttccagctcacatgccatgcgccagtaatgttcttctttccactgttgaaggaaaagaagactttgcgagaagaattgagaaggaatacaaagttgaattgacaccggaacatcgaattcacattcgtacacttgctagctttatcgtcaactacaaacgtaatattaaaagtgatacgttgtttattgacgaagcgctcatgtcgcatccgggtcaaatcttctatgccatagccctttccggtgccaccgaagtcaaacttctcggtgacgtactgcaaattccgtacgttaaccgcacccctgcttacactaccaagtatcaccgcctcgctgacttcgtccccatcatcgataccctctacatttcttatcgatgtcctactgacgtcgctgccagactcgactctcattatgccgaactcaacaacaacggatgtggaatgaaatctgttaagttctctaccaacacctgcaaagtcgtacgactgagcaatgagaacttccctcacgacaagaatgtgcagtaccttacttttactcagaatgaaaagaagaaacttgagctgctgcaccttcgtgtttccacaattcacgagtttcaaggtaaagaagcaaaggtcatacgcgttgtcaggcttaatccattcccccaggaagaactgtttttgcggttcaattacgctctcgttgccctcactcgtcacacggaacagctcacctactacactcgcgttaccaccgacgcgctctctaagcttattaaggtcgacggcatcacatgtcatgtcgctgtttctgaagacgagtgtcgtcgtgtccatcacattaccgctggtgtcgctgacactgaagtgtttcgaatcgccgagaaccttcctgtcgctacgtacaccactatgagtgttgttaagtcgcccatcaccactatcactgaaccacgcctctacttcgtgcctcagttcggaaagaagtcggattgcaaacacaaaccattggtcatgcgatccaacgtcgttgtcgatagttcacgcggtcagctcaatgtctacgtcgtttcctctgtttcccagaaccagaaacacaacctcaccacgatcactaagaatctgcgcgaatgcgcgcccattcttcatgaacgaggtgtcggacgtatcttcgtgtctggtgccgttgaatctgacatcgaccgtgccgccctcggttataccatgtacaagtcactgagagctaaatcgtacctttgctctaccaatgatgtgtacgacgtgccttccgaggttttcgaacttctcacacgaaacggcatgaatcctcttccgaattgccagttcgagtcctcaaaattctccaccgccgactacatacctgttcacgatgtccctcatgtgttctctgtctgtaccgctcaaacctttatcaccagtttcttcgggccttgcgctttcaccgaccagtcttttgacggttgggacgtacgtaacagcgacctcaacattgaagtcggggaaatctcgttctcacctgttggttgcgtacaactaggaaaaatgtttgacacaatgcgtccgattttgcgaacacccatgcctcacatccgtgattacaacactcgcgaactcatgttggctcttgaaaagcggaaccgcaatgtaccttccatgaacggagtcgtcgacattgaagtatcatcttctgaaatgctcgactccttgctcgaggaatgctttgatcctgcacttttgcgcttccacctcgctgaaccaatcactatttcctcgaactcggtaggtgaatggttgagtggccagcctctctccgtcagacccatgattgttcccgattttgcattgcactgtcttgcacttaatgagtacaacttctctattaaacgcaagccgaaacccaacctcaccgttgatgctactgcctcgtatcttgcgttgcagaccatcgtttatcacgaaaagtccatcaacgccatgttttgctccatctttcgtgagatcaagaaacgcgtcacctcttctcttttgcctcatgtaaaaatcttctgcgatatgtcttccgaggatttcgaagaagtgctccaacgtgatattcccccgtccaaactttctgctgtttgcgacaagttagagatcgacattagcaaatacgacaaaagtcaacgcgaacttgccctcgagttcgaatgcaaactcatgctgcgtttcggagtcgctccagacattgtcgagctgtggtttaatgcacatgtgctcacgcgtgtgtatgacaagaccaccaaattgaaagcactggtctcgtaccaacgcaagtcaggagacgcttccactttcatagggaacacactgttcttgatggctgtggtttgcgacctcatccctgtttctcaattggaactcgccttgttctctggtgatgactcactcctttacggacattcgctttcgcagtttaagaacgcacagcatttcggactcaagttcaaccttgagatcaagtttttcgagtttgacaagtcgtacttctgctcaaagttcttgctcgtcgtcaacgaccattggactttcacccctgatccattaaagttcatcaccaaacttggtagacatgatcttgtcaatccccttcacgtagaagaataccgtatttcatttgttgacaccgtcaaaaactacaagaactacgcagtttgcgtcgccgtcgccgatgcattgtgcgaacggtatggtgtattcaaaaacttcacaaacttccttgcctcgcttccgaacatgaccgatgaacgcaatttcaaccagctgttctattctgaactgggagaccgtattgaccacacagtcgtgttcagtcgtgatttctaatctaatcactgatcttccattgttaatcattatgcgcctcccgttcctgttcgtttgccttttcctcaccgccgagtgcgctgttttcagcagcgatgttgtcaaccagctctcaacgcggcgagaaaaactcgctttttatcagaagtttcatcctgttttgaaatccctcggtcgtcatcgtatttctccgtacatgttcgaccggtcttgcctcaatgtctaccgcacaaacgattatttgtttggtgagtgcacccttccacctaattgttccgagccatctgtcgtcaagctcgataaaacattttacggtcaggaaaccgttgtctgtcactcttcgtcccggaaagacaaatcgagtgaattcgagttcttcaacatctcattcactccccgaccggtcgcactccgcgaacctatcactctctatggtaaagtgtttactcaacttaagaatatgaaaccagtatctttctttgagtggtactatatcgtaaagtccgacgacaacaggttcggaattgtaccgcgtatttgtgacgaacttttccatcactcctcccgtctgcccaaaactgtgcgtattgaacatcgtggtgacgacgtttgtttcgtcgaactcgcacatgactcccttcaatgtgatcccatccttttccccagtctgcccgtacttttcactgtccacgacttccccatcgagttcgacggagtgccattttcacagggttctttcgcttccaccaataacaaagttatgggagcggacgcttactctacgaacaacctcacacgcactcctcgagttatcgataaggttggaggttcgtatatggtgacttacgatgcactggactattccggacctcgtttcattgtccgcagtcatgcttacctcccgactgacaaaccctattgcttccaccttgccgcacattacacttctccgctttcaaacatcctttccaacgtgtccaagttttttcgtaacgaattgggatacctccttgaatttttaaaagaaatcgccgccgatcttgcattcattttgttcaaaatcataagcgaaatcttcgacatcatcatgtcgtttgtgccttacaactctcacttctacagtgcgctgtttgtttgttccttcacgtatttgatgttgcgcgacctcgtcatttctttggcagtcctcgtcgctgtttattgtgtaaaaatctattcagattcttccatataatgtgtattcatcttcttctcctaatcgtactaatttactacttgtacaatgtctgctgccccccgaaagcgatctgcaggcaggactgtggctgccgcccgttccaccacttcccagaaggttgctgtccctactgctccgaagaaatcaaccccggcgaagcggaaccgatcgaacactatgttcgatcttaactccgtcatttccgacatctcgtcaacgttcactaagggtcttaaccgacctctagtcttgctgagtgtcgtttgcgtcgttgccctcgtcgtcacccacaatgctgacttctcctccggagttgtcggtaagtggattgccgaaaagtccgcttccaactcccttgcactctgggtccatcagaaccaggtgcggtttcttggactcgccgttttccttcccgccgttctcgacacacccgacaacgtccgcgtcgccgtagctctcgcctcatgtttctgggtgatgcttattcccgcggtctctatttatgaatatgtcatccaggctctcgcacttcacacttacttccgtgtgacactgcagaactcccgcatcttcatcctcctggctgttggtgtgctctactttttcgggcacatcacccttagcccaccctcaacacccggtgctcttgcaccgaattcaacttccgcatagacgaactccacaggagatgtagtctgcacactttgtgccattggtgaactcccttctggagatgtagccagtccttacgacacccttgcatcactctgatgcaaactcttggtgaactcctcttggagatgtaaccacttcaagctccttccgagcatcgctgcgatttgccgccgcgtcaagtaatttcttggaaaacccttaaatttttctaaattcactctctttacttctttctcttttaccataattggcaaaaaaaaaaaaaaaaaaaaaaaaaaaaaaaaa

SEQ ID NO: 8 - DNA, 10059 bp, unknown
  unknown virus
ataaaactatactaacgtattggcttatcaggtttgtatccaggtacagatcatagtcggtttccatccaggtgggaactgtataccggcggctcgtaaggcgagttgctgtaaactggtacgtagccagactacgtactgtaataactggagtcccgaattacgcgactctgtaaaccccggtgttccgctagacggatcactgtataattgctgctcatctaggtgaggagtgtaaactgaataacgttaagcgctattctcaaacaccacgacgttctttcgggagcgtcgtttaactgctgactttctagaaagtcagtgtaaaaattccgcaagttcgcttgtggatctaaaataggagaaactttcgaggtttctcccgtctgtcttgtgctcagcttgcttttgacggacagtgttgcacacgcgttgttacagaagaccgaattttgctcttctacgcctcgcctacgcttcacatctctgtctctcgcagccgcactgtcttcgtgctttgcgacttgatagaacaactgcacttccatcatttggaactgctgaggaccggacttgctcctcacgcacccaactcgttgttggtgcatcgttcttctttcgggaagcactgtctcactgtctccggatttcactttccggggtctgtctagcgctctactgagcccttctctcttcgtctcttggccaaggacgattatacactttcatcatgacgagttcaagcgtgcccaccacctttgacgaccatactcgcaatgctatcctcgaccaactgcgtcagaacacctctatggactatggtgccatgcaagaaaatgtcaagactgcgatgttgaaacagatcatcgcgtctgagcagacgaaggaaatttttgtcgctgctgcatttaacgaagccacgcaggcactcgacgcgaaaagttcacaggaaaagatcgttgtgcaccaaaggttgtccaaggaagatcaggaccgtctgagaaagaccttttgcatgttcagtctggacttttccagagccacagactgtgcatctcatgcattttggcgcgcgcacagattcctttctgagaggaaaatgctgcgcgcagcagggattaagccctgttccagaccttgtaacggctacgatgtcgtttacaaggatgtcggtggtaaccctaccacccatcttaacagaggggagttgtacgtgcacacttgtgcccctctgctttctaacaatgacgacaagcgacactccgcgtacaaagaacgtttgcgcagaggtaacccgaggttcaagaacctcgtttacgaaaagcacgtgaacggtgactcacaagtcatctgcaaccgtcgttctgagaattgttcaataaaagctgaagttcttattttcctgcattcatcttatgacatgtctctcggcaacattgccgacgccatgcacagggctaacgcccgcactgcttacggtgtgtttcacttcaatccgcgcgttctctatgagaagcgcgggaagctgttgaacggcatgtgtttcgagaaacgtgtggtgaatgggcgagtaaaaataagattctggtatgaaaacgactgccaagaaggatatgaacacgattacataaggtatgtctctctgcttcgaactttcagaatacaatcgtcttctgacaaaccgcgttattacaacgtgcagttcgatacttcagatgatgacaccgccttctttataatccgacagtctatcagcggagacattccggcctccaactgtttcagagttttcaccaatgagtcacttgaagggaaactcctcctgtacacgtgggagtggagtactcttaattcgggtactttcagcagttccacattgtccaggatgaaacccgtcaggttgataattgaagagaaactctacaacaaagggatggcattcgctgctaccttacctgactcgaagctttctgtgaaaaacattctcatagcactcacgagctttaacagtcgcgaggtgattagtggacaaaatatcggagttgttgatccgaccgatccttacaccgtgcgactgcttgccgtcacaatttttatgctcacgtatgtgcagaattacgaaggctccaaatgcttgtccaacctcatgcgtgatgaggatcgcgtccgcgaggaatccgattccgggttcttcgtgcgactcttccgcatcaaagtcagattgccgtggaatcatcgtgtgcagaagtttaggggtcgaatggacgaactccgcagtgagattcagtcattcgaagacaagctttctgttgtcgatgatctcacgacttctaacattaaacgcatgatcactgaattcaagagttggaccgatgtcgaaagacgtttcgaaatgcacatcgaccacatgtgcaacttcctgactattaaccaggagctggactgtttgctgatggacgcgtccccatgcgatcggggctttgtgtcctacagtccagtcgtcgacatcgttgacactgacagcattcgtgaagctgccctcaatgcgtatgagagtgtgaagaccgctgacacatcctacgactccgggtcgtacaagattgacaattgcgtcgttgaccttgctcctgttcccaattcgtcgaatggacactgtgttttccagtcgatgattgatagcggtgtagaactgaacgtcgaacaactgcgattgcggttggcggcgagtccgttcatggttaacttgagacatgcgtctcttcaacgtaatttgttgaattgtatggacgggagcgagaagggttacggtgatcttgacactttcattcttttttctctcgagttccaacaaggtgtgtgtgtgcacgttgatggactatgcaagacttttggcccccctcctttgaaacattttgaaataaaggagaaacattgcacgtttttgaaattgtgtcatacttttgacgcagttccttcctattcactcagcacgctggatgataaggaaaaaattgagtatgattcatgcgccagggatgccatgtttgatgctttctttgatttgaaatcccaatttccgtccaataatgtttacaaacagcgattggctgctgccaaacgtaattattgtccactcagcgagctcggaaacggtaactatctctgcagatcaggattgaagactgcggaaatgttcgctcgctattttgacgaaaagttgaactcggctgtaaccattggtggtccaggcggagaagcacagtttctgtgtaataaaggcatcagaaccttcggtataacgaagatttcattgattgacttttctcctgccttgtctgattaccaccattttacccaactgactggtgacgagtatgacggtgacatcatgcggatgtccaacatcctctctttccgcgcttccgttcgcgccgtttaccccgcaggagttgacttcttcgggggagacgctgcgaccgcttcagatcacgattctcaggttgactccggagagatggttgagctgatttcgtgggaggttgtgtgcatgtctgtccttcttcgcaagggtggggatgcatacttcaaggtttttggacttcttgaacatggcatgcctaggatcgttatggtcctgaatcgcatattctccagcatgcagatcgtcaaacttgaaaccagtcgcgccgcgtctactgagctccacattatctgtaaggactatcagcttgaggatgacattccctcatacgtttactcccgtcttatcgagagtagcgtgttgccagtccccacgggtatcgtgatgaactgccgccacgctcagaagatgttcgactcttttatcatcaaaggtctgcgacaatatgaaatggcttttaacactattggaacgtctaacgaattaattaatcgcttcccttcctcgaagatcgaagggtacaggagtgttctgtgcttaccatcccgcatcaccgccgggggaatcactgacgctgtccgtcgaacatttcgcaagatttacaacgtcgacagcgacagggattatctggctgagttgcgggactttaagtacgtggtcgaaattcccgaacccgttccttcggacgctgacgtcgctcacgccgccctcgattgggaaccggaagagggactcctcttcgctgaagtccctgagtccgctagcgtcgtgaaaacgatcttttcgaggaatagaagcgatccttttttaactagcaccgagaaggacgggtccttcaccgttattggagaaacccgtcatactggaattacttatgacgcgccgaaggtcgatgtccctagggtggacttcgacatcgcgcgaaagacgtcaggggaagtcgctgatgtacccgctttcattgcgggtcccagcaaaacaaaagtccacaagctcacacctagtgatgcgatgactgagtgccttgaactcactaagtgtactttgtcaactcatgtcagcaatcattctagactgttgcgcaagttggaccagatccctatgaagtcgtctttcgtgcgagaagaaagtggtgtctactcttactgcgagtatcgcaaagacaccggaccgacgctgttgcttggcgctgcgattgctaatcgcagtttcaacaagtttttctattctgacgggttccactccatgaaggacatcgaccgtgtcatgaccgacgggggcaggtttctcctatctgagtactgcgagattgctgtcgagcaggaactgattgagacctactcttctgtcgacataaaaggttttaagatgcccgacggtgttggaatcgtccaagcggggccgggatgcgggaaaacaacatttgttgtcaacaactccatcccgccccacatgcccggtgcaactaatgtaattctgtcaactgttgagggaaaagatgactttattcgacgcatcgagaagaagtacagggtgacattgacaaaggaacaactagtctacataagaacgatggccagcttcctggttaaccccaagaagaatgctttcagtgatctgttgattatcgatgaagcgcttatggcccatccaggtcagctgttcttcgccatagctatttcgcgggcgaaggaggtgaaattgcttggcgactgtttgcagattccgtacgttaacaggacccctgcattcgtcactaagtgtcacaagctgatcgactttgtccctgtcgttgaaactttgtacatctcttatcgatgtccgaccgacgtcgctgcccgattggacaagaagtatctggcccacaacagaccgaacggtgttaaccgcggtctgatgtcgaccaggttcagcttgaacacttgcaaggtcatcaaactctctaatgacaacttccccaaagaccccgagatccagtatctcgtctttactcaggctgagaagcaaaagttgttgttgcacaagttgcaggtctctactgtgcatgaataccaaggaaaagaaagtaaacgcatcagggttgtccgcttgaacccgtaccctcaggacgagatctacaaacgtgaaaactatgcgcttgttgctctcactagacacaccgaatcactcgagtattacactcgggtcacttcagacgctttgtcacagatgatcaaagttgacggtgtgacatgtcatgtcgcaatgtctgaagatgagaatcgtcggtgtttccatgtgagtgccggtgctattgaacatgaggtttttcgcgtcgccaatagttctcctaacccgatgttgtctaccatcactgtcgtcccaactccgatctccgcaattaaggaaccgcgcctctattttgtgccacggttcgggagaaagaacgactgtaagtttaagcctttggtcatgcagtctgatttctcaatccagacccgcaacggtgtcgtgaacatttttgtcgtctcttccgaccaccctacccagaaacataacctcaagaccatcactcgcaacctgaagtctctgtcccccactatctcccgaatcggcatgccgaggatcttcgtcgcagggtccgtggaaaatgacatcgaaagatcggccgtcggactggttctctacaagaatatcaggtcgaaagccgttctgtgttccactgtcaatcaatacgatgtgccccgcgaagtttttgacttgctgacgaagaatgggatctgcagctctcctaactccactttcacgtccacgaccttcattgagcccgaggcctctttcattttcgagattgagagagacttcgacgtcactaccgcccagcacttcatcactagtttctttggtgagtgtgcttacgtcgaccaggcttatgatgcgtgggacgtgcggaactccccgttgaacatagaagttggacgtatccagttcaatccggtcgtttgcgttcagctgaaccgagagtttgacatgatgcgccccgtgctgtacacccccatgcctttcatgagggattacaactgcagggagatcatgttagctcttgagaaaaggaaccgcaacgtgccgaatatgaacggaatcgtcgactttgacgaggggtcgtccgcgatgttggagtcgttgattcgagagtgtttcgatgaaaagctgctgcagtttcatttgaaggagagagtggccgtgtcgatgaactcagtttacgagtggttgtcgaagcaacctacggggactaaggaactcattgtgcccgatttcgcactgcaccaatccgctctgaactcatatacgttttcaatcaagagaaaaccaaagccgaatttgacggtcgatgcaaccaaatcctacctggcgttgcagaccattgtttatcacgaaaaaccgattaatgccatgttctgttcgatcttcagggaaattaagagcagggtgacgatgtctctcaaacgacacgtgaagattttctgcgatatgtccgccgaggattttgaagatgtgttgaatcgtgacatcccacccagttcattgtctgcctgcattgacaaactcgagatcgacatcagcaaatacgataagagtcagagggagctcgcgctcgacttcgagtgcaagctcatgtcttatttcggtgtggacgctgacatcgttgaactttggttcaacgctcacgtcctcaccgaggtttatgacaagaccaccaagatgaaggcgttgattccatatcagcggaagtcgggtgacgcgtccacattcatcggaaacactttgttcctgatggctgtggtctgcgatctgattcccgtttctgagttggagatggcgctcttttctggtgatgactcgttgctctatggacatgacatggaccggtatcgtgattctcagcactttggtttgaagttcaatcttgagattaagttcttcgagtttgagctttcgtatttttgctcaaagttcttgttggctgtccgcgacagatggacgtttactcctgaccccgtgaaatttatgaccaaactcggacgtcacgatctcgtgaatccgcttcacgtagaggagtatcgcatatctttcgtggataccgtgcgaaattaccgcagttatcatgtgtgcaaggccgtcgctgtggcccttagagaacgctatggtgttcgcaccgatcacaccgcctttctgatgacgcttcattcaatgacgtcgctgaccaacttcccgaagttgttctacagtattgacggtgatcggatcgattactccattgtgttctctagggacttttgaatctacagagagtctctcatacatgactgtgtaagtccaaccatgaagttccttgtcttcttcctttctgtggtcaatgctgccgtttttgttaaggacgtcacctatcagctctcctcaactcgagagcgaatggctctttatcaaaacctttccccatcccttgtgaagttcggttcccatcaaatctctccctatcacactgatcccacatgcgtcagtgtgtacaggaccaatgattggttcttcgctggatgtgaactcccaccccattgtctgggtaaagttgtctcaatcatcgaaaagaagtggtacggtcaagagactgttttctgtcactcttcgtaccaccccgacaagactgagacctatgagttctactccatcgacttcccgatcagtaagcgcacagtgaaaccgaagaagcctgtcgaattacacggaaaggtgattcctattattaagaatctccgtcccgtctccttcttcgagtatttcgtggtcgctcgcaactcttcgggatttggtttggtcccgaacttctgtatggaccgtttgcgtaacggaactcagttgcctaagaacgtcaagctcaggcacgaatccgacagagtgtgtgtcgacatcgtctctcatgatgagcatgactgccatcccgtcatgttccctaccgtgatgcaaatgataatgcattacgacttcccggtcgaattcgacgacgtgcccttctcacagggatcgtacgccgccactaattgcaaagcaattggtgcagacgcgtacatgtctgaacacgcttcgcagaagcctgtgcacgttttggacaagatcgggggttctttcatggtaacttttgagaggctgtcgtctgactcacgcatgtttgtcgttaagaactctcaacgcctgggtgcaactgagtcccgttgttacgacttccatactcattacacctcccccctttccaacattttgtcccaagttggtacgttccttcgagacgagcttgtcgagctcttgatgttcctgaagaaacttgccaagcccattgcagaaatcttcctttttgtcgtgtcagagctgcttaccctcttcacggacctcattccctacaccggggatttctacaccggcctttttgtgtttttggttgtgtatatcgcttccttcaacgtcggtgtgtcagccctggtgggtctactggtctaccttttcagaatctacctcgattctgtcatattctgacatgtatgtcttactgtgtactcttttttgcatcttcctccgcaaccctgctctgctccacacccttttctgggttttggttttggagaggtatacgaaggagatcctgaatctatacagaatctttcatacaagtcaagatgaactcaacccggaaaactttcaagacttccgctcgcagccctggcgcggttgtttctgccgcccgcaacaccacaccgaggaaggctgttgcccgtcctgcgccgaagaagacgcaggactcgtctttcgatctaaataagatcgtgtccgacgtgtcctccaccttcttcagcgctctaaacagaccgctcgtccttctctccttggtgatggttgtcgcctttgtattcactcaccagagtgatttttcttccggtgctgtcggcaaatatgttgccgaacgcgccgagaccaactccctagctaagtgggtgcacgagaaccaattcaagtttcttggtttggctatcttcgcccccgccgtgctcaattcgcccgagaagatgcgcgttgtccttggactcgcgacccttctctgggtgatgttggtccctcaagcctccgtccttgagtacgttctgcaggcgctcgctctgcattcgtacttccgtgtgaggctccagcagtcacgacttttcatcatggtcgtggttgttttcctgtacttcatggggtatcttaccctcgtgaagtccccggaccaacaggtccaatcgggcaatggtactgtctgagagatgtagtcataacccttctggtgcggtgaactctcccattgtcctgagacgtagtcgtcggtccttctgaccgcggcgaactcgaatattactgccccttctgggcggagacgtagagatcgttccttctgaaccctcgaactccaccaagtcccttctggacgaacgttttgatttgcccaagacgtgaagttattaattcttcgaatactttaaattcttttcagtgccgatcatcttgtcggcaattaccattttcttaattcttttacctaattggcaaaaaaaaaaaaaaaaaaaaaaaaaaaaaaa

SEQ ID NO: 9 - DNA, 7011 bp, unknown
  unknown virus
  CDS (1)..(7011)
atgacgagttcaagcgtgcccaccacctttgacgaccatactcgcaatgctatcctcgaccaactgcgtcagaacacctctatggactatggtgccatgcaagaaaatgtcaagactgcgatgttgaaacagatcatcgcgtctgagcagacgaaggaaatttttgtcgctgctgcatttaacgaagccacgcaggcactcgacgcgaaaagttcacaggaaaagatcgttgtgcaccaaaggttgtccaaggaagatcaggaccgtctgagaaagaccttttgcatgttcagtctggacttttccagagccacagactgtgcatctcatgcattttggcgcgcgcacagattcctttctgagaggaaaatgctgcgcgcagcagggattaagccctgttccagaccttgtaacggctacgatgtcgtttacaaggatgtcggtggtaaccctaccacccatcttaacagaggggagttgtacgtgcacacttgtgcccctctgctttctaacaatgacgacaagcgacactccgcgtacaaagaacgtttgcgcagaggtaacccgaggttcaagaacctcgtttacgaaaagcacgtgaacggtgactcacaagtcatctgcaaccgtcgttctgagaattgttcaataaaagctgaagttcttattttcctgcattcatcttatgacatgtctctcggcaacattgccgacgccatgcacagggctaacgcccgcactgcttacggtgtgtttcacttcaatccgcgcgttctctatgagaagcgcgggaagctgttgaacggcatgtgtttcgagaaacgtgtggtgaatgggcgagtaaaaataagattctggtatgaaaacgactgccaagaaggatatgaacacgattacataaggtatgtctctctgcttcgaactttcagaatacaatcgtcttctgacaaaccgcgttattacaacgtgcagttcgatacttcagatgatgacaccgccttctttataatccgacagtctatcagcggagacattccggcctccaactgtttcagagttttcaccaatgagtcacttgaagggaaactcctcctgtacacgtgggagtggagtactcttaattcgggtactttcagcagttccacattgtccaggatgaaacccgtcaggttgataattgaagagaaactctacaacaaagggatggcattcgctgctaccttacctgactcgaagctttctgtgaaaaacattctcatagcactcacgagctttaacagtcgcgaggtgattagtggacaaaatatcggagttgttgatccgaccgatccttacaccgtgcgactgcttgccgtcacaatttttatgctcacgtatgtgcagaattacgaaggctccaaatgcttgtccaacctcatgcgtgatgaggatcgcgtccgcgaggaatccgattccgggttcttcgtgcgactcttccgcatcaaagtcagattgccgtggaatcatcgtgtgcagaagtttaggggtcgaatggacgaactccgcagtgagattcagtcattcgaagacaagctttctgttgtcgatgatctcacgacttctaacattaaacgcatgatcactgaattcaagagttggaccgatgtcgaaagacgtttcgaaatgcacatcgaccacatgtgcaacttcctgactattaaccaggagctggactgtttgctgatggacgcgtccccatgcgatcggggctttgtgtcctacagtccagtcgtcgacatcgttgacactgacagcattcgtgaagctgccctcaatgcgtatgagagtgtgaagaccgctgacacatcctacgactccgggtcgtacaagattgacaattgcgtcgttgaccttgctcctgttcccaattcgtcgaatggacactgtgttttccagtcgatgattgatagcggtgtagaactgaacgtcgaacaactgcgattgcggttggcggcgagtccgttcatggttaacttgagacatgcgtctcttcaacgtaatttgttgaattgtatggacgggagcgagaagggttacggtgatcttgacactttcattcttttttctctcgagttccaacaaggtgtgtgtgtgcacgttgatggactatgcaagacttttggcccccctcctttgaaacattttgaaataaaggagaaacattgcacgtttttgaaattgtgtcatacttttgacgcagttccttcctattcactcagcacgctggatgataaggaaaaaattgagtatgattcatgcgccagggatgccatgtttgatgctttctttgatttgaaatcccaatttccgtccaataatgtttacaaacagcgattggctgctgccaaacgtaattattgtccactcagcgagctcggaaacggtaactatctctgcagatcaggattgaagactgcggaaatgttcgctcgctattttgacgaaaagttgaactcggctgtaaccattggtggtccaggcggagaagcacagtttctgtgtaataaaggcatcagaaccttcggtataacgaagatttcattgattgacttttctcctgccttgtctgattaccaccattttacccaactgactggtgacgagtatgacggtgacatcatgcggatgtccaacatcctctctttccgcgcttccgttcgcgccgtttaccccgcaggagttgacttcttcgggggagacgctgcgaccgcttcagatcacgattctcaggttgactccggagagatggttgagctgatttcgtgggaggttgtgtgcatgtctgtccttcttcgcaagggtggggatgcatacttcaaggtttttggacttcttgaacatggcatgcctaggatcgttatggtcctgaatcgcatattctccagcatgcagatcgtcaaacttgaaaccagtcgcgccgcgtctactgagctccacattatctgtaaggactatcagcttgaggatgacattccctcatacgtttactcccgtcttatcgagagtagcgtgttgccagtccccacgggtatcgtgatgaactgccgccacgctcagaagatgttcgactcttttatcatcaaaggtctgcgacaatatgaaatggcttttaacactattggaacgtctaacgaattaattaatcgcttcccttcctcgaagatcgaagggtacaggagtgttctgtgcttaccatcccgcatcaccgccgggggaatcactgacgctgtccgtcgaacatttcgcaagatttacaacgtcgacagcgacagggattatctggctgagttgcgggactttaagtacgtggtcgaaattcccgaacccgttccttcggacgctgacgtcgctcacgccgccctcgattgggaaccggaagagggactcctcttcgctgaagtccctgagtccgctagcgtcgtgaaaacgatcttttcgaggaatagaagcgatccttttttaactagcaccgagaaggacgggtccttcaccgttattggagaaacccgtcatactggaattacttatgacgcgccgaaggtcgatgtccctagggtggacttcgacatcgcgcgaaagacgtcaggggaagtcgctgatgtacccgctttcattgcgggtcccagcaaaacaaaagtccacaagctcacacctagtgatgcgatgactgagtgccttgaactcactaagtgtactttgtcaactcatgtcagcaatcattctagactgttgcgcaagttggaccagatccctatgaagtcgtctttcgtgcgagaagaaagtggtgtctactcttactgcgagtatcgcaaagacaccggaccgacgctgttgcttggcgctgcgattgctaatcgcagtttcaacaagtttttctattctgacgggttccactccatgaaggacatcgaccgtgtcatgaccgacgggggcaggtttctcctatctgagtactgcgagattgctgtcgagcaggaactgattgagacctactcttctgtcgacataaaaggttttaagatgcccgacggtgttggaatcgtccaagcggggccgggatgcgggaaaacaacatttgttgtcaacaactccatcccgccccacatgcccggtgcaactaatgtaattctgtcaactgttgagggaaaagatgactttattcgacgcatcgagaagaagtacagggtgacattgacaaaggaacaactagtctacataagaacgatggccagcttcctggttaaccccaagaagaatgctttcagtgatctgttgattatcgatgaagcgcttatggcccatccaggtcagctgttcttcgccatagctatttcgcgggcgaaggaggtgaaattgcttggcgactgtttgcagattccgtacgttaacaggacccctgcattcgtcactaagtgtcacaagctgatcgactttgtccctgtcgttgaaactttgtacatctcttatcgatgtccgaccgacgtcgctgcccgattggacaagaagtatctggcccacaacagaccgaacggtgttaaccgcggtctgatgtcgaccaggttcagcttgaacacttgcaaggtcatcaaactctctaatgacaacttccccaaagaccccgagatccagtatctcgtctttactcaggctgagaagcaaaagttgttgttgcacaagttgcaggtctctactgtgcatgaataccaaggaaaagaaagtaaacgcatcagggttgtccgcttgaacccgtaccctcaggacgagatctacaaacgtgaaaactatgcgcttgttgctctcactagacacaccgaatcactcgagtattacactcgggtcacttcagacgctttgtcacagatgatcaaagttgacggtgtgacatgtcatgtcgcaatgtctgaagatgagaatcgtcggtgtttccatgtgagtgccggtgctattgaacatgaggtttttcgcgtcgccaatagttctcctaacccgatgttgtctaccatcactgtcgtcccaactccgatctccgcaattaaggaaccgcgcctctattttgtgccacggttcgggagaaagaacgactgtaagtttaagcctttggtcatgcagtctgatttctcaatccagacccgcaacggtgtcgtgaacatttttgtcgtctcttccgaccaccctacccagaaacataacctcaagaccatcactcgcaacctgaagtctctgtcccccactatctcccgaatcggcatgccgaggatcttcgtcgcagggtccgtggaaaatgacatcgaaagatcggccgtcggactggttctctacaagaatatcaggtcgaaagccgttctgtgttccactgtcaatcaatacgatgtgccccgcgaagtttttgacttgctgacgaagaatgggatctgcagctctcctaactccactttcacgtccacgaccttcattgagcccgaggcctctttcattttcgagattgagagagacttcgacgtcactaccgcccagcacttcatcactagtttctttggtgagtgtgcttacgtcgaccaggcttatgatgcgtgggacgtgcggaactccccgttgaacatagaagttggacgtatccagttcaatccggtcgtttgcgttcagctgaaccgagagtttgacatgatgcgccccgtgctgtacacccccatgcctttcatgagggattacaactgcagggagatcatgttagctcttgagaaaaggaaccgcaacgtgccgaatatgaacggaatcgtcgactttgacgaggggtcgtccgcgatgttggagtcgttgattcgagagtgtttcgatgaaaagctgctgcagtttcatttgaaggagagagtggccgtgtcgatgaactcagtttacgagtggttgtcgaagcaacctacggggactaaggaactcattgtgcccgatttcgcactgcaccaatccgctctgaactcatatacgttttcaatcaagagaaaaccaaagccgaatttgacggtcgatgcaaccaaatcctacctggcgttgcagaccattgtttatcacgaaaaaccgattaatgccatgttctgttcgatcttcagggaaattaagagcagggtgacgatgtctctcaaacgacacgtgaagattttctgcgatatgtccgccgaggattttgaagatgtgttgaatcgtgacatcccacccagttcattgtctgcctgcattgacaaactcgagatcgacatcagcaaatacgataagagtcagagggagctcgcgctcgacttcgagtgcaagctcatgtcttatttcggtgtggacgctgacatcgttgaactttggttcaacgctcacgtcctcaccgaggtttatgacaagaccaccaagatgaaggcgttgattccatatcagcggaagtcgggtgacgcgtccacattcatcggaaacactttgttcctgatggctgtggtctgcgatctgattcccgtttctgagttggagatggcgctcttttctggtgatgactcgttgctctatggacatgacatggaccggtatcgtgattctcagcactttggtttgaagttcaatcttgagattaagttcttcgagtttgagctttcgtatttttgctcaaagttcttgttggctgtccgcgacagatggacgtttactcctgaccccgtgaaatttatgaccaaactcggacgtcacgatctcgtgaatccgcttcacgtagaggagtatcgcatatctttcgtggataccgtgcgaaattaccgcagttatcatgtgtgcaaggccgtcgctgtggcccttagagaacgctatggtgttcgcaccgatcacaccgcctttctgatgacgcttcattcaatgacgtcgctgaccaacttcccgaagttgttctacagtattgacggtgatcggatcgattactccattgtgttctctagggacttttga

SEQ ID NO: 10 - protein, 2336 aa, unknown
  Synthetic Construct
MTSSSVPTTFDDHTRNAILDQLRQNTSMDYGAMQENVKTAMLKQIIASEQTKEIFVAAAFNEATQALDAKSSQEKIVVHQRLSKEDQDRLRKTFCMFSLDFSRATDCASHAFWRAHRFLSERKMLRAAGIKPCSRPCNGYDVVYKDVGGNPTTHLNRGELYVHTCAPLLSNNDDKRHSAYKERLRRGNPRFKNLVYEKHVNGDSQVICNRRSENCSIKAEVLIFLHSSYDMSLGNIADAMHRANARTAYGVFHFNPRVLYEKRGKLLNGMCFEKRVVNGRVKIRFWYENDCQEGYEHDYIRYVSLLRTFRIQSSSDKPRYYNVQFDTSDDDTAFFIIRQSISGDIPASNCFRVFTNESLEGKLLLYTWEWSTLNSGTFSSSTLSRMKPVRLIIEEKLYNKGMAFAATLPDSKLSVKNILIALTSFNSREVISGQNIGVVDPTDPYTVRLLAVTIFMLTYVQNYEGSKCLSNLMRDEDRVREESDSGFFVRLFRIKVRLPWNHRVQKFRGRMDELRSEIQSFEDKLSVVDDLTTSNIKRMITEFKSWTDVERRFEMHIDHMCNFLTINQELDCLLMDASPCDRGFVSYSPVVDIVDTDSIREAALNAYESVKTADTSYDSGSYKIDNCVVDLAPVPNSSNGHCVFQSMIDSGVELNVEQLRLRLAASPFMVNLRHASLQRNLLNCMDGSEKGYGDLDTFILFSLEFQQGVCVHVDGLCKTFGPPPLKHFEIKEKHCTFLKLCHTFDAVPSYSLSTLDDKEKIEYDSCARDAMFDAFFDLKSQFPSNNVYKQRLAAAKRNYCPLSELGNGNYLCRSGLKTAEMFARYFDEKLNSAVTIGGPGGEAQFLCNKGIRTFGITKISLIDFSPALSDYHHFTQLTGDEYDGDIMRMSNILSFRASVRAVYPAGVDFFGGDAATASDHDSQVDSGEMVELISWEVVCMSVLLRKGGDAYFKVFGLLEHGMPRIVMVLNRIFSSMQIVKLETSRAASTELHIICKDYQLEDDIPSYVYSRLIESSVLPVPTGIVMNCRHAQKMFDSFIIKGLRQYEMAFNTIGTSNELINRFPSSKIEGYRSVLCLPSRITAGGITDAVRRTFRKIYNVDSDRDYLAELRDFKYVVEIPEPVPSDADVAHAALDWEPEEGLLFAEVPESASVVKTIFSRNRSDPFLTSTEKDGSFTVIGETRHTGITYDAPKVDVPRVDFDIARKTSGEVADVPAFIAGPSKTKVHKLTPSDAMTECLELTKCTLSTHVSNHSRLLRKLDQIPMKSSFVREESGVYSYCEYRKDTGPTLLLGAAIANRSFNKFFYSDGFHSMKDIDRVMTDGGRFLLSEYCEIAVEQELIETYSSVDIKGFKMPDGVGIVQAGPGCGKTTFVVNNSIPPHMPGATNVILSTVEGKDDFIRRIEKKYRVTLTKEQLVYIRTMASFLVNPKKNAFSDLLIIDEALMAHPGQLFFAIAISRAKEVKLLGDCLQIPYVNRTPAFVTKCHKLIDFVPVVETLYISYRCPTDVAARLDKKYLAHNRPNGVNRGLMSTRFSLNTCKVIKLSNDNFPKDPEIQYLVFTQAEKQKLLLHKLQVSTVHEYQGKESKRIRVVRLNPYPQDEIYKRENYALVALTRHTESLEYYTRVTSDALSQMIKVDGVTCHVAMSEDENRRCFHVSAGAIEHEVFRVANSSPNPMLSTITVVPTPISAIKEPRLYFVPRFGRKNDCKFKPLVMQSDFSIQTRNGVVNIFVVSSDHPTQKHNLKTITRNLKSLSPTISRIGMPRIFVAGSVENDIERSAVGLVLYKNIRSKAVLCSTVNQYDVPREVFDLLTKNGICSSPNSTFTSTTFIEPEASFIFEIERDFDVTTAQHFITSFFGECAYVDQAYDAWDVRNSPLNIEVGRIQFNPVVCVQLNREFDMMRPVLYTPMPFMRDYNCREIMLALEKRNRNVPNMNGIVDFDEGSSAMLESLIRECFDEKLLQFHLKERVAVSMNSVYEWLSKQPTGTKELIVPDFALHQSALNSYTFSIKRKPKPNLTVDATKSYLALQTIVYHEKPINAMFCSIFREIKSRVTMSLKRHVKIFCDMSAEDFEDVLNRDIPPSSLSACIDKLEIDISKYDKSQRELALDFECKLMSYFGVDADIVELWFNAHVLTEVYDKTTKMKALIPYQRKSGDASTFIGNTLFLMAVVCDLIPVSELEMALFSGDDSLLYGHDMDRYRDSQHFGLKFNLEIKFFEFELSYFCSKFLLAVRDRWTFTPDPVKFMTKLGRHDLVNPLHVEEYRISFVDTVRNYRSYHVCKAVAVALRERYGVRTDHTAFLMTLHSMTSLTNFPKLFYSIDGDRIDYSIVFSRDF

SEQ ID NO: 11 - DNA, 9011 bp, unknown
  unknown virus
aacgtggtacctaaagaaacgattgtcgattacatcgccgacaatcttcaactcgaacttggagttactaactctaagttaattcatcagaatcttgtacgcaaggttcttgacaacactgaccttggcaatcttgtcacggaagcacacattgaccgtgcgaacgcgcacgctcttcagaaggctaatcaaaagaaagtcttcgtaaaacagaaagtctcaaaagaccaagaacgtatccttcgagatcgcttttggggctttcaactcgacttttcagctgctatggattcaggctcgcactctttccatcgcgctcatagaattctatcacgtagtaaattcatgcatgaccttggtattgaacgtaattcaaaaccccgcggatcatatgatgctgtttacaaagacgttggtggaaatcctatcactcatcttcatgaaaacttcgtacatacatgtttcccattactatcaaataatgacgacaaacgtcattctaattatcttcataaacttcgtacttctcgaccatctcacgctcatcgagaaattatcaagaaacacactgaaggagacagtcgcgtgatctgtcaccgtgtttctcaaaactgtaaaattaaagcaccttatttaattttcctccattcaacttatgacatgactcctttaaatatcgccgaagctatgtatcatgctgacgcactaatcggaaaggggtgttttattttcagtcctaaaattctttatgaaaattccggttcgcttaaccatgacttaaatttttctaaattcatccgtgacggtgaaatttatatccgtttttggtttactaacgataaccaagagggttatgaacatcttttctctacttatatttcccttcttcgaactacccgaatcggctttagtggatgtagttataatgtagagttcgaggatcagaaggaagatgacgttgtattttttacaattcgcaaatcaatttctggatctattccccgaagcaacgtctttcgtacctttactgattcttctctcgactcaaaaattattgtctactactggcgatgggaaaccttgaatgaaggcacttttttcaactctcttgagaatcatatgaaaccaattcgtcttgtagctccgatgcgattgtatcttaaacttcgcgggtatgctgacactctctctgatactaaattcactgttcaaaaccttttgaaggccgctgtgaactttaatacgcgtgaagtgatcagtggtcagagtgttggcctcgttgaccccgtcgaccccgatactctcaagcatttggtttttgcaacctatttggttacttatatttccaattatgaatgttttaagacactcagcactcttcaaaaggacgaagaccgtgttcgttctctcagtagctctttctttttgcgacgtatgttctcaaatggattttgggctctacgtaagcatataatgggtctcacttctatgtcgactcgcaatatttcgttcgatataaaggaccttgactcccttgattcatgccgtaactctcttcatatacgtaacacccttgagaaattgctcggtaatgacaagctcgaggttcgtcgtcgtttcgggattgctattcgtgatcgtctagtgcgctttataaccgttgatgaagagcttgaagctctcaccctcgaccgtgaattgcacaacgtatctgtagtaccagacgaaacgataaactcggctgttgaccctgttcttgttcgtgatgccattatgtccaatctcgaacaatcgttgcctaatgaaagatccttttcccgtgctgatcttgttcatgaaacttgtactgcattcgtcacaattcaccccaatacgtcgaatggagactgttttttccagtctgtgatcgacttgggtctatttcctgggacaacatgtgaactccgctcccgtctcaagaattcaacacatctgctctcaatgtatgactcttcatctataagacaatctttgaatgtgactgatggttcccgcaatggattcatgcctctcgagacattcgtccttctttctcttgagttcgacatacgtgtttgcgtgcactattctggtcgtagcttacgattcggaaaaggtaaagtatatcattttgacgttcgcaatgaccattgttctgctctcaaatatcgtcatgaattccaagacgctccgtctgtccccttttctactgactctcgctccccacacaatactactgaggaccgagataaaaatttttcaatgttcttcgaaggagaacacaatatgacaaaaagtcaattccgcgcaaatcttaaaactgcacgtgaattgtattatcctttatctgctcttggtaacggcggttatatctgtcgtagtggtttaaagaccgctgaaatgttcgagcgttattttgataaagatatcgagtcagctatatctataggtggaccaggtgctgaagtacagtacttggttaacaagcttggaatccgtgttttcggtattacccatactgaaaagatcgatttcgcaattcctgactatcctgcgttcgttcagctttacggtgagactggtgatggtgacatcatcccctcaaagaataaggttgactttatcaagaaaatcaagctcgaatttcccaacggtgttgattttttcggtggagacattgctgataattctgaatatattacagactacgaaggtgctgcagatcttgttatccatgagattgtccttgccaacgctatattaaaaaacggtggtcaggcatatttcaaggtttttgatctgacgtccccgaagagtcttaagttcgcttttgtattggaaaagatgttcggtaatgtcactgccgttaaactcgatacatctcgcgccgcctgtaccgaaattcatttaatttgtcatgactttaaccaatccaattcttcagaaaattttaatttacttacttctaattgtattgaaattccttcagactttgaacagaaaatgaattatattaccaatcggttcaatgacatttttaatggtggacttaatcgtctcaaaaagtgtttcttcaagattggtacacgttcgcctcaatccttccaattttctgatgaaattgttgagggattccgtgcctctttagctcttgacaatgaggtacgaatgggtactaattggacacgaatttcctccgctgtgtccgctgttcaccagttcttctcacctcgagatgttgaaattgaactagcggatctgatggttcgtcccatcgaagtagttgttgatgacatcaccgaaacttcgatagatgatgaaccgtcaatctatgaggaggcagttgaggatgttgttgatcctcctcagcctgaaattgttccaccatctgaacctgaagtaataattccaaaacgtcgctcctttaagaaactattctcgaagaagaagaagaaacctgtgaatgatacgcctgttgaatatacgacactcgatcaaaatgtgcctaccggtattgattctgacctactgcgctctccgatcgctgttgatctggaatcacggcctgaggctccggttgtcggaatttctttaggtgattgtgatgaagaagatttcactcccccaagaatccaatctcacggttatcgtgctgctatgcgtgagttcattgaactcacaaaattcacttatgaatctgaacgcagcaatcatagccgtgtgtttaagaggttgagtcaccttctacccacaaatcatattattcgcaacgaacgtggaaatttcggtcttatcgagactgatggtgaacgttttcagtacgtattccgcccggaaatagccgtagaaaattataacaagtgcttcgacggtgaatcctttattgaattcgctgatgctatagctaaacctggtcgttacctcgtttctgattactgtgaactttgtctcgataaggaaatgattgacgcttgctcacaagtcgacattgattcgttcatccttccggatgagtgctcaattgttcaggccgctcctggttgtggtaagacacattttattgtcaataactgtgtcccaccttccagtgaagacgccagcaacatcctcctctctacacgagagggtagggatgattttgctcgtcgtctaaaaaaacgcgacccttccgcaactgaaaatcaaatcaagactcacgttcgtactctagctagctttcttctcaactcttctcgcaataaaaagtcacgaactctcttcattgatgaagctcttatggctcatcctggtatgatctttttcgccatcgcgatctctggtgccgatgtaattcgtatgcttggggacattcttcaaattcctttcgttaaccgcacaccagcttttcggtgtaagtatttgaatcttcagtcctttgtttcaatttctgaaaccctgtatgtgtcttatcgttgccctcctgatgtcgctatgcgtcttaattctcattaccttaaggaaaattctaaaaatggtttcaactttggcatgtcttcggctgtacgtaatcttgagaacacgtgtacgtatgtccacattcagaacgataacttcaacaaggaggctcatcgtgggaagaagattttggtcttcacccagggtgagaaaaccaagttgaagggctacggactggatgtgtctactgtgcacgaatatcaaggtaaggaagctgacgaaatcgttgtcgtccgactcgatccttataagactagcgaaatttatcttcgtttcaactatgcccttgttgccctgaccagacataaacgtaaactcacttattacacccgtgttcccaccgacgctttggctactctcattcgcgtgaatggtacaaccgtcaaagaactctattctcgcgaagaaattgaacagagcatccatgtgtcgatgggagcttgggaagatgttgagtttgacttcactcaatacactactcctaaatcctattcgtctttgaagactgttcaaacttccttaaaacacgtatcctcccataatcgaatctttttcgtccctcgtctcggtaaacattatcatagatcgaaaccctacttcatgtcatcacctgtacacattgttcgaaatttctatgggaaatttgatatctttttaacttcgaaattttcttgcaagaagaaaaccgacttgaatatgttgaaagagtctctatccgtcttagtcaaaaagaagtttttcgatgacggcactttattcttttgtgctgattctatcactgatgacttggattctgagattctgtcacacgttttattcaaacatgctaataattatcggttcgctttttgtatcaatgaatatcttgacgatatcccttctcaggttttcgaacttgaatgtatgaatggattttcttatattgataacaaagtgattactcgctgcgagacgaatgaatacgaaacccctattattttttctgaatctacttgttcatttgatattaatcatgctcaaatttttctgaacagtgtcttttctgacatttgctttatcgacttatcttttgatgagtacgacgtattcaattcagatatcaaccttgaacttggagatattacatattcccgaatttctgctcaaaattacgaatctccttatgagaatatgattcctaatctgcactccccttgcccttttgatcgtaaatataactaccgtgaaattttgttagctcttgaaaaaagaaatcgcaacgttccatattttaacggcgtcgttgactatgaccgtgtctcctctgaaatgcttgatgctttgttacgtgaatgtttcgacccgtatcgtctgagactcgcctgttctgatcctgtaaggattggttctggtgatattcattcgtggctaaagaagcaacctttagaagttcacgatcagattgttccatcttttgctatgcacaatgacgctcttaaccaatattccttctcgattaagaaacaagcaaaacctaatcttactgttgatgctgcatcttcttatgccgctcttcagacaattgtataccatgaaaaacatattaatgccgttttctgtacaatgttcactgagctaaagaaacgtgtccgttattctctccggaagaacgtaaaaattttttcggatatttcgacatctgatttcgaaaagatgttggactcggacattcctcccgaatcgctggatcctctcttggatcaccttgagattgatatcagtaagtacgacaagtctcaacgcgaattggctcttgaacttgaatgtaaaatacttcggcaatttggaatcgaagaggaacttgtccaattgtggtttaatgctcacattttgacttacatttatgacaaaaattcaaaattgaaagctgcgattccttatcagcgtaagagcggtgatgcgtctacttttattggcaacactctttttttaatggctgttattagccttcttattccagtttctcagatgtatctcgccctcttttccggtgacgattccctaatttacggttaccaccttaagaagtatatggacactcagcattttggtttaatgtttaatctcgaaataaaatttttccaatttctattatcttatttttgttcacgctttttgctaatcgtggacggtcattggacattcactcctgatccagttaaattgttcgtcaaactcggtcgacacaatttaattaaccctgctcacgtagaagaataccgtatcagtttgatcgacaattgtcgtggattcgaaaattcattgatttgtgaccacgtcgcaatggcggtctgtgagcgatatggtattataaataatttctctacgcttttttattctattccggatatgttgaagaaggagaatttccacactctttatactatccctaatggaaaaattaaccccaatacattcagtaattcctttgacttttaaactaatttcatttctaccatattcttctctaaaatgcttgtccttagaatcttcctctttttctatttgttgtcttttattcattcttccttaatgaagaatgagattctgtctaaacttaactctaggcagaatcgaatattttatcaaaaattcaaatttcattataatttttctgcctaccatccttctccttttgaatttgacccggaatgtatcgaagttcatcgcacacattcttggttctttcaaggttgtacacttcctccttcatgtggtgatgtacatacaaaaattctcgactcgtctttcggtttcaaagaattaatgtgttattcttttcataagtcccaaaacctttctcttgttaacatttctcccttttcctctttctctaaattcaattttacatttaaaaatcaattgaaagattatggatactttgaaactttagaaaacattgaacccgttgactttttcgagcattttttcttgtacgtccacaatggcttatattctttgctaccaaaaatttgtatagacaattatatcacccctggtcaaccctttccttcatccgtgttattttcttcgtctcatgatgacgtctgttttactcataatacgggtggtattaattgtgaattgaaactttttaaatcagttggtgagctttttatgcactataattttcctctgaaatttcgtaattcgcctttttctacccattcctatgagaaaacaggaaacaccgaaattcatgcaattgaaaattatcagcctttaaattctgtatatttacttgacaataatagtccttactcttattcagtatcatcttctgttcacctcactcctaccccttatgtgttacggtttcctattcacaattataatgggaagacccattgttttaaggttcattcaaaatatgtcaatcctttggcctctattttaaagttccttcttcagtctctcacgttaattttttctgaaataattaaagccttggaatttgtccttaaacccataattaacttggctttcaaatttttgaaagccctatatgacgaagtgtctgccttgtttaattctctcttgaattctataccgcaaattgatcatgtacttgacacgcttctcgtgtttgtcctttccttgatccattttcattattaccatgttatattgatctccttattgtacgttttaaacctattttatttctcttatatataatattttaaaaacgttcgaaatgagtacttcacgcattcctgtcccaaatggtgctaaacgccaaaaacccaatggtcaaacgcgagttcctgctccggttaaaaccgttgcagtagcccctcgacctcgtgtttatacgcctgtaaagacggtttcacctcaaaagaaatctaaatcttttgatttaggtgatgctacttctgacatttttaattcttttacatcagcattaaataagcctgctgtaattgttcttgtggctttggtcgccagtattgttcttacacaccagacttcattcgctacctctactatcggaaaatttttgaaagattccgataactctatcgctaaatggattcttaagaattcgaccaaatttctaggtatgttaatttttatacctgctctgtataacttaccttccaaattacgtcctgtaatttcaattgccaccgtcttttggtgccttttggttcctgaatcttcaatatatcagtacgtgattcaatccttttctctacacacttatttcaaagtgtctcagtccaatacccggcttttaattgtcggtattgttggtctttcttattatttaggatggttctccccatcactttctccagcaaaatcccccgcaacaaatggaacgggtgtataaccgcatccctgaagtcttttcttcaaaactcgtattttaggttcaaaattttcataactcccttccgtaatttcttttcttttattggttaaaaaaaaaaaaaaaaaaaaaaaaaaaaaaa

SEQ ID NO: 12 - DNA, 7014 bp, unknown
  unknown virus
  CDS (1)..(7014)
atgacgtccatacctacggtatcaaacgtggtacctaaagaaacgattgtcgattacatcgccgacaatcttcaactcgaacttggagttactaactctaagttaattcatcagaatcttgtacgcaaggttcttgacaacactgaccttggcaatcttgtcacggaagcacacattgaccgtgcgaacgcgcacgctcttcagaaggctaatcaaaagaaagtcttcgtaaaacagaaagtctcaaaagaccaagaacgtatccttcgagatcgcttttggggctttcaactcgacttttcagctgctatggattcaggctcgcactctttccatcgcgctcatagaattctatcacgtagtaaattcatgcatgaccttggtattgaacgtaattcaaaaccccgcggatcatatgatgctgtttacaaagacgttggtggaaatcctatcactcatcttcatgaaaacttcgtacatacatgtttcccattactatcaaataatgacgacaaacgtcattctaattatcttcataaacttcgtacttctcgaccatctcacgctcatcgagaaattatcaagaaacacactgaaggagacagtcgcgtgatctgtcaccgtgtttctcaaaactgtaaaattaaagcaccttatttaattttcctccattcaacttatgacatgactcctttaaatatcgccgaagctatgtatcatgctgacgcactaatcggaaaggggtgttttattttcagtcctaaaattctttatgaaaattccggttcgcttaaccatgacttaaatttttctaaattcatccgtgacggtgaaatttatatccgtttttggtttactaacgataaccaagagggttatgaacatcttttctctacttatatttcccttcttcgaactacccgaatcggctttagtggatgtagttataatgtagagttcgaggatcagaaggaagatgacgttgtattttttacaattcgcaaatcaatttctggatctattccccgaagcaacgtctttcgtacctttactgattcttctctcgactcaaaaattattgtctactactggcgatgggaaaccttgaatgaaggcacttttttcaactctcttgagaatcatatgaaaccaattcgtcttgtagctccgatgcgattgtatcttaaacttcgcgggtatgctgacactctctctgatactaaattcactgttcaaaaccttttgaaggccgctgtgaactttaatacgcgtgaagtgatcagtggtcagagtgttggcctcgttgaccccgtcgaccccgatactctcaagcatttggtttttgcaacctatttggttacttatatttccaattatgaatgttttaagacactcagcactcttcaaaaggacgaagaccgtgttcgttctctcagtagctctttctttttgcgacgtatgttctcaaatggattttgggctctacgtaagcatataatgggtctcacttctatgtcgactcgcaatatttcgttcgatataaaggaccttgactcccttgattcatgccgtaactctcttcatatacgtaacacccttgagaaattgctcggtaatgacaagctcgaggttcgtcgtcgtttcgggattgctattcgtgatcgtctagtgcgctttataaccgttgatgaagagcttgaagctctcaccctcgaccgtgaattgcacaacgtatctgtagtaccagacgaaacgataaactcggctgttgaccctgttcttgttcgtgatgccattatgtccaatctcgaacaatcgttgcctaatgaaagatccttttcccgtgctgatcttgttcatgaaacttgtactgcattcgtcacaattcaccccaatacgtcgaatggagactgttttttccagtctgtgatcgacttgggtctatttcctgggacaacatgtgaactccgctcccgtctcaagaattcaacacatctgctctcaatgtatgactcttcatctataagacaatctttgaatgtgactgatggttcccgcaatggattcatgcctctcgagacattcgtccttctttctcttgagttcgacatacgtgtttgcgtgcactattctggtcgtagcttacgattcggaaaaggtaaagtatatcattttgacgttcgcaatgaccattgttctgctctcaaatatcgtcatgaattccaagacgctccgtctgtccccttttctactgactctcgctccccacacaatactactgaggaccgagataaaaatttttcaatgttcttcgaaggagaacacaatatgacaaaaagtcaattccgcgcaaatcttaaaactgcacgtgaattgtattatcctttatctgctcttggtaacggcggttatatctgtcgtagtggtttaaagaccgctgaaatgttcgagcgttattttgataaagatatcgagtcagctatatctataggtggaccaggtgctgaagtacagtacttggttaacaagcttggaatccgtgttttcggtattacccatactgaaaagatcgatttcgcaattcctgactatcctgcgttcgttcagctttacggtgagactggtgatggtgacatcatcccctcaaagaataaggttgactttatcaagaaaatcaagctcgaatttcccaacggtgttgattttttcggtggagacattgctgataattctgaatatattacagactacgaaggtgctgcagatcttgttatccatgagattgtccttgccaacgctatattaaaaaacggtggtcaggcatatttcaaggtttttgatctgacgtccccgaagagtcttaagttcgcttttgtattggaaaagatgttcggtaatgtcactgccgttaaactcgatacatctcgcgccgcctgtaccgaaattcatttaatttgtcatgactttaaccaatccaattcttcagaaaattttaatttacttacttctaattgtattgaaattccttcagactttgaacagaaaatgaattatattaccaatcggttcaatgacatttttaatggtggacttaatcgtctcaaaaagtgtttcttcaagattggtacacgttcgcctcaatccttccaattttctgatgaaattgttgagggattccgtgcctctttagctcttgacaatgaggtacgaatgggtactaattggacacgaatttcctccgctgtgtccgctgttcaccagttcttctcacctcgagatgttgaaattgaactagcggatctgatggttcgtcccatcgaagtagttgttgatgacatcaccgaaacttcgatagatgatgaaccgtcaatctatgaggaggcagttgaggatgttgttgatcctcctcagcctgaaattgttccaccatctgaacctgaagtaataattccaaaacgtcgctcctttaagaaactattctcgaagaagaagaagaaacctgtgaatgatacgcctgttgaatatacgacactcgatcaaaatgtgcctaccggtattgattctgacctactgcgctctccgatcgctgttgatctggaatcacggcctgaggctccggttgtcggaatttctttaggtgattgtgatgaagaagatttcactcccccaagaatccaatctcacggttatcgtgctgctatgcgtgagttcattgaactcacaaaattcacttatgaatctgaacgcagcaatcatagccgtgtgtttaagaggttgagtcaccttctacccacaaatcatattattcgcaacgaacgtggaaatttcggtcttatcgagactgatggtgaacgttttcagtacgtattccgcccggaaatagccgtagaaaattataacaagtgcttcgacggtgaatcctttattgaattcgctgatgctatagctaaacctggtcgttacctcgtttctgattactgtgaactttgtctcgataaggaaatgattgacgcttgctcacaagtcgacattgattcgttcatccttccggatgagtgctcaattgttcaggccgctcctggttgtggtaagacacattttattgtcaataactgtgtcccaccttccagtgaagacgccagcaacatcctcctctctacacgagagggtagggatgattttgctcgtcgtctaaaaaaacgcgacccttccgcaactgaaaatcaaatcaagactcacgttcgtactctagctagctttcttctcaactcttctcgcaataaaaagtcacgaactctcttcattgatgaagctcttatggctcatcctggtatgatctttttcgccatcgcgatctctggtgccgatgtaattcgtatgcttggggacattcttcaaattcctttcgttaaccgcacaccagcttttcggtgtaagtatttgaatcttcagtcctttgtttcaatttctgaaaccctgtatgtgtcttatcgttgccctcctgatgtcgctatgcgtcttaattctcattaccttaaggaaaattctaaaaatggtttcaactttggcatgtcttcggctgtacgtaatcttgagaacacgtgtacgtatgtccacattcagaacgataacttcaacaaggaggctcatcgtgggaagaagattttggtcttcacccagggtgagaaaaccaagttgaagggctacggactggatgtgtctactgtgcacgaatatcaaggtaaggaagctgacgaaatcgttgtcgtccgactcgatccttataagactagcgaaatttatcttcgtttcaactatgcccttgttgccctgaccagacataaacgtaaactcacttattacacccgtgttcccaccgacgctttggctactctcattcgcgtgaatggtacaaccgtcaaagaactctattctcgcgaagaaattgaacagagcatccatgtgtcgatgggagcttgggaagatgttgagtttgacttcactcaatacactactcctaaatcctattcgtctttgaagactgttcaaacttccttaaaacacgtatcctcccataatcgaatctttttcgtccctcgtctcggtaaacattatcatagatcgaaaccctacttcatgtcatcacctgtacacattgttcgaaatttctatgggaaatttgatatctttttaacttcgaaattttcttgcaagaagaaaaccgacttgaatatgttgaaagagtctctatccgtcttagtcaaaaagaagtttttcgatgacggcactttattcttttgtgctgattctatcactgatgacttggattctgagattctgtcacacgttttattcaaacatgctaataattatcggttcgctttttgtatcaatgaatatcttgacgatatcccttctcaggttttcgaacttgaatgtatgaatggattttcttatattgataacaaagtgattactcgctgcgagacgaatgaatacgaaacccctattattttttctgaatctacttgttcatttgatattaatcatgctcaaatttttctgaacagtgtcttttctgacatttgctttatcgacttatcttttgatgagtacgacgtattcaattcagatatcaaccttgaacttggagatattacatattcccgaatttctgctcaaaattacgaatctccttatgagaatatgattcctaatctgcactccccttgcccttttgatcgtaaatataactaccgtgaaattttgttagctcttgaaaaaagaaatcgcaacgttccatattttaacggcgtcgttgactatgaccgtgtctcctctgaaatgcttgatgctttgttacgtgaatgtttcgacccgtatcgtctgagactcgcctgttctgatcctgtaaggattggttctggtgatattcattcgtggctaaagaagcaacctttagaagttcacgatcagattgttccatcttttgctatgcacaatgacgctcttaaccaatattccttctcgattaagaaacaagcaaaacctaatcttactgttgatgctgcatcttcttatgccgctcttcagacaattgtataccatgaaaaacatattaatgccgttttctgtacaatgttcactgagctaaagaaacgtgtccgttattctctccggaagaacgtaaaaattttttcggatatttcgacatctgatttcgaaaagatgttggactcggacattcctcccgaatcgctggatcctctcttggatcaccttgagattgatatcagtaagtacgacaagtctcaacgcgaattggctcttgaacttgaatgtaaaatacttcggcaatttggaatcgaagaggaacttgtccaattgtggtttaatgctcacattttgacttacatttatgacaaaaattcaaaattgaaagctgcgattccttatcagcgtaagagcggtgatgcgtctacttttattggcaacactctttttttaatggctgttattagccttcttattccagtttctcagatgtatctcgccctcttttccggtgacgattccctaatttacggttaccaccttaagaagtatatggacactcagcattttggtttaatgtttaatctcgaaataaaatttttccaatttctattatcttatttttgttcacgctttttgctaatcgtggacggtcattggacattcactcctgatccagttaaattgttcgtcaaactcggtcgacacaatttaattaaccctgctcacgtagaagaataccgtatcagtttgatcgacaattgtcgtggattcgaaaattcattgatttgtgaccacgtcgcaatggcggtctgtgagcgatatggtattataaataatttctctacgcttttttattctattccggatatgttgaagaaggagaatttccacactctttatactatccctaatggaaaaattaaccccaatacattcagtaattcctttgacttttaa

SEQ ID NO: 13 - protein, 2337 aa, unknown
  Synthetic Construct
MTSIPTVSNVVPKETIVDYIADNLQLELGVTNSKLIHQNLVRKVLDNTDLGNLVTEAHIDRANAHALQKANQKKVFVKQKVSKDQERILRDRFWGFQLDFSAAMDSGSHSFHRAHRILSRSKFMHDLGIERNSKPRGSYDAVYKDVGGNPITHLHENFVHTCFPLLSNNDDKRHSNYLHKLRTSRPSHAHREIIKKHTEGDSRVICHRVSQNCKIKAPYLIFLHSTYDMTPLNIAEAMYHADALIGKGCFIFSPKILYENSGSLNHDLNFSKFIRDGEIYIRFWFTNDNQEGYEHLFSTYISLLRTTRIGFSGCSYNVEFEDQKEDDVVFFTIRKSISGSIPRSNVFRTFTDSSLDSKIIVYYWRWETLNEGTFFNSLENHMKPIRLVAPMRLYLKLRGYADTLSDTKFTVQNLLKAAVNFNTREVISGQSVGLVDPVDPDTLKHLVFATYLVTYISNYECFKTLSTLQKDEDRVRSLSSSFFLRRMFSNGFWALRKHIMGLTSMSTRNISFDIKDLDSLDSCRNSLHIRNTLEKLLGNDKLEVRRRFGIAIRDRLVRFITVDEELEALTLDRELHNVSVVPDETINSAVDPVLVRDAIMSNLEQSLPNERSFSRADLVHETCTAFVTIHPNTSNGDCFFQSVIDLGLFPGTTCELRSRLKNSTHLLSMYDSSSIRQSLNVTDGSRNGFMPLETFVLLSLEFDIRVCVHYSGRSLRFGKGKVYHFDVRNDHCSALKYRHEFQDAPSVPFSTDSRSPHNTTEDRDKNFSMFFEGEHNMTKSQFRANLKTARELYYPLSALGNGGYICRSGLKTAEMFERYFDKDIESAISIGGPGAEVQYLVNKLGIRVFGITHTEKIDFAIPDYPAFVQLYGETGDGDIIPSKNKVDFIKKIKLEFPNGVDFFGGDIADNSEYITDYEGAADLVIHEIVLANAILKNGGQAYFKVFDLTSPKSLKFAFVLEKMFGNVTAVKLDTSRAACTEIHLICHDFNQSNSSENFNLLTSNCIEIPSDFEQKMNYITNRFNDIFNGGLNRLKKCFFKIGTRSPQSFQFSDEIVEGFRASLALDNEVRMGTNWTRISSAVSAVHQFFSPRDVEIELADLMVRPIEVVVDDITETSIDDEPSIYEEAVEDVVDPPQPEIVPPSEPEVIIPKRRSFKKLFSKKKKKPVNDTPVEYTTLDQNVPTGIDSDLLRSPIAVDLESRPEAPVVGISLGDCDEEDFTPPRIQSHGYRAAMREFIELTKFTYESERSNHSRVFKRLSHLLPTNHIIRNERGNFGLIETDGERFQYVFRPEIAVENYNKCFDGESFIEFADAIAKPGRYLVSDYCELCLDKEMIDACSQVDIDSFILPDECSIVQAAPGCGKTHFIVNNCVPPSSEDASNILLSTREGRDDFARRLKKRDPSATENQIKTHVRTLASFLLNSSRNKKSRTLFIDEALMAHPGMIFFAIAISGADVIRMLGDILQIPFVNRTPAFRCKYLNLQSFVSISETLYVSYRCPPDVAMRLNSHYLKENSKNGFNFGMSSAVRNLENTCTYVHIQNDNFNKEAHRGKKILVFTQGEKTKLKGYGLDVSTVHEYQGKEADEIVVVRLDPYKTSEIYLRFNYALVALTRHKRKLTYYTRVPTDALATLIRVNGTTVKELYSREEIEQSIHVSMGAWEDVEFDFTQYTTPKSYSSLKTVQTSLKHVSSHNRIFFVPRLGKHYHRSKPYFMSSPVHIVRNFYGKFDIFLTSKFSCKKKTDLNMLKESLSVLVKKKFFDDGTLFFCADSITDDLDSEILSHVLFKHANNYRFAFCINEYLDDIPSQVFELECMNGFSYIDNKVITRCETNEYETPIIFSESTCSFDINHAQIFLNSVFSDICFIDLSFDEYDVFNSDINLELGDITYSRISAQNYESPYENMIPNLHSPCPFDRKYNYREILLALEKRNRNVPYFNGVVDYDRVSSEMLDALLRECFDPYRLRLACSDPVRIGSGDIHSWLKKQPLEVHDQIVPSFAMHNDALNQYSFSIKKQAKPNLTVDAASSYAALQTIVYHEKHINAVFCTMFTELKKRVRYSLRKNVKIFSDISTSDFEKMLDSDIPPESLDPLLDHLEIDISKYDKSQRELALELECKILRQFGIEEELVQLWFNAHILTYIYDKNSKLKAAIPYQRKSGDASTFIGNTLFLMAVISLLIPVSQMYLALFSGDDSLIYGYHLKKYMDTQHFGLMFNLEIKFFQFLLSYFCSRFLLIVDGHWTFTPDPVKLFVKLGRHNLINPAHVEEYRISLIDNCRGFENSLICDHVAMAVCERYGIINNFSTLFYSIPDMLKKENFHTLYTIPNGKINPNTFSNSFDF

SEQ ID NO: 14 - DNA, 9011 bp, unknown
  unknown virus
acgtggtacctaaagaaacgattgtcgattacatcgccgacaatcttcaactcgaacttggagttactaactctaagttaattcatcagaatcttgtacgcaaggttcttgacaacactgaccttggcaatcttgtcacggaagcacacattgaccgtgcgaacgcgcacgctcttcagaaggctaatcaaaagaaagtcttcgtaaaacagaaagtctcaaaagaccaagaacgtatccttcgagatcgcttttggggctttcaactcgacttttcagctgctatggattcaggctcgcactctttccatcgcgctcatagaattctatcacgtagtaaattcatgcatgaccttggtattgaacgtaattcaaaaccccgcggatcatatgatgctgtttacaaagacgttggtggaaatcctatcactcatcttcatgaaaacttcgtacatacatgtttcccattactatcaaataatgacgacaaacgtcattctaattatcttcataaacttcgtacttctcgaccatctcacgctcatcgagaaattatcaagaaacacactgaaggagacagtcgcgtgatctgtcaccgtgtttctcaaaactgtaaaattaaagcaccttatttaattttcctccattcaacttatgacatgactcctttaaatatcgccgaagctatgtatcatgctgacgcactaatcggaaaggggtgttttattttcagtcctaaaattctttatgaaaattccggttcgcttaaccatgacttaaatttttctaaattcatccgtgacggtgaaatttatatccgtttttggtttactaacgataaccaagagggttatgaacatcttttctctacttatatttcccttcttcgaactacccgaatcggctttagtggatgtagttataatgtagagttcgaggatcagaaggaagatgacgttgtattttttacaattcgcaaatcaatttctggatctattccccgaagcaacgtctttcgtacctttactgattcttctctcgactcaaaaattattgtctactactggcgatgggaaaccttgaatgaaggcacttttttcaactctcttgagaatcatatgaaaccaattcgtcttgtagctccgatgcgattgtatcttaaacttcgcgggtatgctgacactctctctgatactaaattcactgttcaaaaccttttgaaggccgctgtgaactttaatacgcgtgaagtgatcagtggtcagagtgttggcctcgttgaccccgtcgaccccgatactctcaagcatttggtttttgcaacctatttggttacttatatttccaattatgaatgttttaagacactcagcactcttcaaaaggacgaagaccgtgttcgttctctcagtagctctttctttttgcgacgtatgttctcaaatggattttgggctctacgtaagcatataatgggtctcacttctatgtcgactcgcaatatttcgttcgatataaaggaccttgactcccttgattcatgccgtaactctcttcatatacgtaacacccttgagaaattgctcggtaatgacaagctcgaggttcgtcgtcgtttcgggattgctattcgtgatcgtctagtgcgctttataaccgttgatgaagagcttgaagctctcaccctcgaccgtgaattgcacaacgtatctgtagtaccagacgaaacgataaactcggctgttgaccctgttcttgttcgtgatgccattatgtccaatctcgaacaatcgttgcctaatgaaagatccttttcccgtgctgatcttgttcatgaaacttgtactgcattcgtcacaattcaccccaatacgtcgaatggagactgttttttccagtctgtgatcgacttgggtctatttcctgggacaacatgtgaactccgctcccgtctcaagaattcaacacatctgctctcaatgtatgactcttcatctataagacaatctttgaatgtgactgatggttcccgcaatggattcatgcctctcgagacattcgtccttctttctcttgagttcgacatacgtgtttgcgtgcactattctggtcgtagcttacgattcggaaaaggtaaagtatatcattttgacgttcgcaatgaccattgttctgctctcaaatatcgtcatgaattccaagacgctccgtctgtccccttttctactgactctcgctccccacacaatactactgaggaccgagataaaaatttttcaatgttcttcgaaggagaacacaatatgacaaaaagtcaattccgcgcaaatcttaaaactgcacgtgaattgtattatcctttatctgctcttggtaacggcggttatatctgtcgtagtggtttaaagaccgctgaaatgttcgagcgttattttgataaagatatcgagtcagctatatctataggtggaccaggtgctgaagtacagtacttggttaacaagcttggaatccgtgttttcggtattacccatactgaaaagatcgatttcgcaattcctgactatcctgcgttcgttcagctttacggtgagactggtgatggtgacatcatcccctcaaagaataaggttgactttatcaagaaaatcaagctcgaatttcccaacggtgttgattttttcggtggagacattgctgataattctgaatatattacagactacgaaggtgctgcagatcttgttatccatgagattgtccttgccaacgctatattaaaaaacggtggtcaggcatatttcaaggtttttgatctgacgtccccgaagagtcttaagttcgcttttgtattggaaaagatgttcggtaatgtcactgccgttaaactcgatacatctcgcgccgcctgtaccgaaattcatttaatttgtcatgactttaaccaatccaattcttcagaaaattttaatttacttacttctaattgtattgaaattccttcagactttgaacagaaaatgaattatattaccaatcggttcaatgacatttttaatggtggacttaatcgtctcaaaaagtgtttcttcaagattggtacacgttcgcctcaatccttccaattttctgatgaaattgttgagggattccgtgcctctttagctcttgacaatgaggtacgaatgggtactaattggacacgaatttcctccgctgtgtccgctgttcaccagttcttctcacctcgagatgttgaaattgaactagcggatctgatggttcgtcccatcgaagtagttgttgatgacatcaccgaaacttcgatagatgatgaaccgtcaatctatgaggaggcagttgaggatgttgttgatcctcctcagcctgaaattgttccaccatctgaacctgaagtaataattccaaaacgtcgctcctttaagaaactattctcgaagaagaagaagaaacctgtgaatgatacgcctgttgaatatacgacactcgatcaaaatgtgcctaccggtattgattctgacctactgcgctctccgatcgctgttgatctggaatcacggcctgaggctccggttgtcggaatttctttaggtgattgtgatgaagaagatttcactcccccaagaatccaatctcacggttatcgtgctgctatgcgtgagttcattgaactcacaaaattcacttatgaatctgaacgcagcaatcatagccgtgtgtttaagaggttgagtcaccttctacccacaaatcatattattcgcaacgaacgtggaaatttcggtcttatcgagactgatggtgaacgttttcagtacgtattccgcccggaaatagccgtagaaaattataacaagtgcttcgacggtgaatcctttattgaattcgctgatgctatagctaaacctggtcgttacctcgtttctgattactgtgaactttgtctcgataaggaaatgattgacgcttgctcacaagtcgacattgattcgttcatccttccggatgagtgctcaattgttcaggccgctcctggttgtggtaagacacattttattgtcaataactgtgtcccaccttccagtgaagacgccagcaacatcctcctctctacacgagagggtagggatgattttgctcgtcgtctaaaaaaacgcgacccttccgcaactgaaaatcaaatcaagactcacgttcgtactctagctagctttcttctcaactcttctcgcaataaaaagtcacgaactctcttcattgatgaagctcttatggctcatcctggtatgatctttttcgccatcgcgatctctggtgccgatgtaattcgtatgcttggggacattcttcaaattcctttcgttaaccgcacaccagcttttcggtgtaagtatttgaatcttcagtcctttgtttcaatttctgaaaccctgtatgtgtcttatcgttgccctcctgatgtcgctatgcgtcttaattctcattaccttaaggaaaattctaaaaatggtttcaactttggcatgtcttcggctgtacgtaatcttgagaacacgtgtacgtatgtccacattcagaacgataacttcaacaaggaggctcatcgtgggaagaagattttggtcttcacccagggtgagaaaaccaagttgaagggctacggactggatgtgtctactgtgcacgaatatcaaggtaaggaagctgacgaaatcgttgtcgtccgactcgatccttataagactagcgaaatttatcttcgtttcaactatgcccttgttgccctgaccagacataaacgtaaactcacttattacacccgtgttcccaccgacgctttggctactctcattcgcgtgaatggtacaaccgtcaaagaactctattctcgcgaagaaattgaacagagcatccatgtgtcgatgggagcttgggaagatgttgagtttgacttcactcaatacactactcctaaatcctattcgtctttgaagactgttcaaacttccttaaaacacgtatcctcccataatcgaatctttttcgtccctcgtctcggtaaacattatcatagatcgaaaccctacttcatgtcatcacctgtacacattgttcgaaatttctatgggaaatttgatatctttttaacttcgaaattttcttgcaagaagaaaaccgacttgaatatgttgaaagagtctctatccgtcttagtcaaaaagaagtttttcgatgacggcactttattcttttgtgctgattctatcactgatgacttggattctgagattctgtcacacgttttattcaaacatgctaataattatcggttcgctttttgtatcaatgaatatcttgacgatatcccttctcaggttttcgaacttgaatgtatgaatggattttcttatattgataacaaagtgattactcgctgcgagacgaatgaatacgaaacccctattattttttctgaatctacttgttcatttgatattaatcatgctcaaatttttctgaacagtgtcttttctgacatttgctttatcgacttatcttttgatgagtacgacgtattcaattcagatatcaaccttgaacttggagatattacatattcccgaatttctgctcaaaattacgaatctccttatgagaatatgattcctaatctgcactccccttgcccttttgatcgtaaatataactaccgtgaaattttgttagctcttgaaaaaagaaatcgcaacgttccatattttaacggcgtcgttgactatgaccgtgtctcctctgaaatgcttgatgctttgttacgtgaatgtttcgacccgtatcgtctgagactcgcctgttctgatcctgtaaggattggttctggtgatattcattcgtggctaaagaagcaacctttagaagttcacgatcagattgttccatcttttgctatgcacaatgacgctcttaaccaatattccttctcgattaagaaacaagcaaaacctaatcttactgttgatgctgcatcttcttatgccgctcttcagacaattgtataccatgaaaaacatattaatgccgttttctgtacaatgttcactgagctaaagaaacgtgtccgttattctctccggaagaacgtaaaaattttttcggatatttcgacatctgatttcgaaaagatgttggactcggacattcctcccgaatcgctggatcctctcttggatcaccttgagattgatatcagtaagtacgacaagtctcaacgcgaattggctcttgaacttgaatgtaaaatacttcggcaatttggaatcgaagaggaacttgtccaattgtggtttaatgctcacattttgacttacatttatgacaaaaattcaaaattgaaagctgcgattccttatcagcgtaagagcggtgatgcgtctacttttattggcaacactctttttttaatggctgttattagccttcttattccagtttctcagatgtatctcgccctcttttccggtgacgattccctaatttacggttaccaccttaagaagtatatggacactcagcattttggtttaatgtttaatctcgaaataaaatttttccaatttctattatcttatttttgttcacgctttttgctaatcgtggacggtcattggacattcactcctgatccagttaaattgttcgtcaaactcggtcgacacaatttaattaaccctgctcacgtagaagaataccgtatcagtttgatcgacaattgtcgtggattcgaaaattcattgatttgtgaccacgtcgcaatggcggtctgtgagcgatatggtattataaataatttctctacgcttttttattctattccggatatgttgaagaaggagaatttccacactctttatactatccctaatggaaaaattaaccccaatacattcagtaattcctttgacttttaaactaatttcatttctaccatattcttctctaaaatgcttgtccttagaatcttcctctttttctatttgttgtcttttattcattcttccttaatgaagaatgagattctgtctaaacttaactctaggcagaatcgaatattttatcaaaaattcaaatttcattataatttttctgcctaccatccttctccttttgaatttgacccggaatgtatcgaagttcatcgcacacattcttggttctttcaaggttgtacacttcctccttcatgtggtgatgtacatacaaaaattctcgactcgtctttcggtttcaaagaattaatgtgttattcttttcataagtcccaaaacctttctcttgttaacatttctcccttttcctctttctctaaattcaattttacatttaaaaatcaattgaaagattatggatactttgaaactttagaaaacattgaacccgttgactttttcgagcattttttcttgtacgtccacaatggcttatattctttgctaccaaaaatttgtatagacaattatatcacccctggtcaaccctttccttcatccgtgttattttcttcgtctcatgatgacgtctgttttactcataatacgggtggtattaattgtgaattgaaactttttaaatcagttggtgagctttttatgcactataattttcctctgaaatttcgtaattcgcctttttctacccattcctatgagaaaacaggaaacaccgaaattcatgcaattgaaaattatcagcctttaaattctgtatatttacttgacaataatagtccttactcttattcagtatcatcttctgttcacctcactcctaccccttatgtgttacggtttcctattcacaattataatgggaagacccattgttttaaggttcattcaaaatatgtcaatcctttggcctctattttaaagttccttcttcagtctctcacgttaattttttctgaaataattaaagccttggaatttgtccttaaacccataattaacttggctttcaaatttttgaaagccctatatgacgaagtgtctgccttgtttaattctctcttgaattctataccgcaaattgatcatgtacttgacacgcttctcgtgtttgtcctttccttgatccattttcattattaccatgctatattgatctccttattgtacgttttaaacctattttatttctcttatatataatattttaaaaacgttcgaaatgagtacttcacgcattcctgtcccaaatggtgctaaacgccaaaaacccaatggtcaaacgcgagttcctgctccggttaaaaccgttgcagtagcccctcgacctcgtgtttatacgcctgtaaagacggtttcacctcaaaagaaatctaaatcttttgatttaggtgatgctacttctgacatttttaattcttttacatcagcattaaataagcctgctgtaattgttcttgtggctttggtcgccagtattgttcttacacaccagacttcattcgctacctctactatcggaaaatttttgaaagattccgataactctatcgctaaatggattcttaagaattcgaccaaatttctaggtatgttaatttttatacctgctctgtataacttaccttccaaattacgtcctgtaatttcaattgccaccgtcttttggtgccttttggttcctgaatcttcaatatatcagtacgtgattcaatccttttctctacacacttatttcaaagtgtctcagtccaatacccggcttttaattgtcggtattgttggtctttcttattatttaggatggttctccccatcactttctccagcaaaatcccccgcaacaaatggaacgggtgtataaccgcatccctgaagtcttttcttcaaaactcgtattttaggttcaaaattttcataactcccttccgtaatttcttttcttttattggttaaaaaaaaaaaaaaaaaaaaaaaaaaaaaaaa

SEQ ID NO: 15 - DNA, 9207 bp, unknown
  unknown virus
atatagcaaacaaatttaattggctgaattcacgcaattcagtcattatcaaaactaatacacgtattacgttttcatcccgtgttattcctcgtgtttaacatatatcacaatctttacacagtactgattgtctttcgtggactcaaacatgacgtccatacctacggtatcaaacgtggtacctaaagaaacgattgtcgattacatcgccgacaatcttcaactcgaacttggagttactaactctaagttaattcatcagaatcttgtacgcaaggttcttgacaacactgaccttggcaatcttgtcacggaagcacacattgaccgtgcgaacgcgcacgctcttcagaaggctaatcaaaagaaagtcttcgtaaaacagaaagtctcaaaagaccaagaacgtatccttcgagatcgcttttggggctttcaactcgacttttcagctgctatggattcaggctcgcactctttccatcgcgctcatagaattctatcacgtagtaaattcatgcatgaccttggtattgaacgtaattcaaaaccccgcggatcatatgatgctgtttacaaagacgttggtggaaatcctatcactcatcttcatgaaaacttcgtacatacatgtttcccattactatcaaataatgacgacaaacgtcattctaattatcttcataaacttcgtacttctcgaccatctcacgctcatcgagaaattatcaagaaacacactgaaggagacagtcgcgtgatctgtcaccgtgtttctcaaaactgtaaaattaaagcaccttatttaattttcctccattcaacttatgacatgactcctttaaatatcgccgaagctatgtatcatgctgacgcactaatcggaaaggggtgttttattttcagtcctaaaattctttatgaaaattccggttcgcttaaccatgacttaaatttttctaaattcatccgtgacggtgaaatttatatccgtttttggtttactaacgataaccaagagggttatgaacatcttttctctacttatatttcccttcttcgaactacccgaatcggctttagtggatgtagttataatgtagagttcgaggatcagaaggaagatgacgttgtattttttacaattcgcaaatcaatttctggatctattccccgaagcaacgtctttcgtacctttactgattcttctctcgactcaaaaattattgtctactactggcgatgggaaaccttgaatgaaggcacttttttcaactctcttgagaatcatatgaaaccaattcgtcttgtagctccgatgcgattgtatcttaaacttcgcgggtatgctgacactctctctgatactaaattcactgttcaaaaccttttgaaggccgctgtgaactttaatacgcgtgaagtgatcagtggtcagagtgttggcctcgttgaccccgtcgaccccgatactctcaagcatttggtttttgcaacctatttggttacttatatttccaattatgaatgttttaagacactcagcactcttcaaaaggacgaagaccgtgttcgttctctcagtagctctttctttttgcgacgtatgttctcaaatggattttgggctctacgtaagcatataatgggtctcacttctatgtcgactcgcaatatttcgttcgatataaaggaccttgactcccttgattcatgccgtaactctcttcatatacgtaacacccttgagaaattgctcggtaatgacaagctcgaggttcgtcgtcgtttcgggattgctattcgtgatcgtctagtgcgctttataaccgttgatgaagagcttgaagctctcaccctcgaccgtgaattgcacaacgtatctgtagtaccagacgaaacgataaactcggctgttgaccctgttcttgttcgtgatgccattatgtccaatctcgaacaatcgttgcctaatgaaagatccttttcccgtgctgatcttgttcatgaaacttgtactgcattcgtcacaattcaccccaatacgtcgaatggagactgttttttccagtctgtgatcgacttgggtctatttcctgggacaacatgtgaactccgctcccgtctcaagaattcaacacatctgctctcaatgtatgactcttcatctataagacaatctttgaatgtgactgatggttcccgcaatggattcatgcctctcgagacattcgtccttctttctcttgagttcgacatacgtgtttgcgtgcactattctggtcgtagcttacgattcggaaaaggtaaagtatatcattttgacgttcgcaatgaccattgttctgctctcaaatatcgtcatgaattccaagacgctccgtctgtccccttttctactgactctcgctccccacacaatactactgaggaccgagataaaaatttttcaatgttcttcgaaggagaacacaatatgacaaaaagtcaattccgcgcaaatcttaaaactgcacgtgaattgtattatcctttatctgctcttggtaacggcggttatatctgtcgtagtggtttaaagaccgctgaaatgttcgagcgttattttgataaagatatcgagtcagctatatctataggtggaccaggtgctgaagtacagtacttggttaacaagcttggaatccgtgttttcggtattacccatactgaaaagatcgatttcgcaattcctgactatcctgcgttcgttcagctttacggtgagactggtgatggtgacatcatcccctcaaagaataaggttgactttatcaagaaaatcaagctcgaatttcccaacggtgttgattttttcggtggagacattgctgataattctgaatatattacagactacgaaggtgctgcagatcttgttatccatgagattgtccttgccaacgctatattaaaaaacggtggtcaggcatatttcaaggtttttgatctgacgtccccgaagagtcttaagttcgcttttgtattggaaaagatgttcggtaatgtcactgccgttaaactcgatacatctcgcgccgcctgtaccgaaattcatttaatttgtcatgactttaaccaatccaattcttcagaaaattttaatttacttacttctaattgtattgaaattccttcagactttgaacagaaaatgaattatattaccaatcggttcaatgacatttttaatggtggacttaatcgtctcaaaaagtgtttcttcaagattggtacacgttcgcctcaatccttccaattttctgatgaaattgttgagggattccgtgcctctttagctcttgacaatgaggtacgaatgggtactaattggacacgaatttcctccgctgtgtccgctgttcaccagttcttctcacctcgagatgttgaaattgaactagcggatctgatggttcgtcccatcgaagtagttgttgatgacatcaccgaaacttcgatagatgatgaaccgtcaatctatgaggaggcagttgaggatgttgttgatcctcctcagcctgaaattgttccaccatctgaacctgaagtaataattccaaaacgtcgctcctttaagaaactattctcgaagaagaagaagaaacctgtgaatgatacgcctgttgaatatacgacactcgatcaaaatgtgcctaccggtattgattctgacctactgcgctctccgatcgctgttgatctggaatcacggcctgaggctccggttgtcggaatttctttaggtgattgtgatgaagaagatttcactcccccaagaatccaatctcacggttatcgtgctgctatgcgtgagttcattgaactcacaaaattcacttatgaatctgaacgcagcaatcatagccgtgtgtttaagaggttgagtcaccttctacccacaaatcatattattcgcaacgaacgtggaaatttcggtcttatcgagactgatggtgaacgttttcagtacgtattccgcccggaaatagccgtagaaaattataacaagtgcttcgacggtgaatcctttattgaattcgctgatgctatagctaaacctggtcgttacctcgtttctgattactgtgaactttgtctcgataaggaaatgattgacgcttgctcacaagtcgacattgattcgttcatccttccggatgagtgctcaattgttcaggccgctcctggttgtggtaagacacattttattgtcaataactgtgtcccaccttccagtgaagacgccagcaacatcctcctctctacacgagagggtagggatgattttgctcgtcgtctaaaaaaacgcgacccttccgcaactgaaaatcaaatcaagactcacgttcgtactctagctagctttcttctcaactcttctcgcaataaaaagtcacgaactctcttcattgatgaagctcttatggctcatcctggtatgatctttttcgccatcgcgatctctggtgccgatgtaattcgtatgcttggggacattcttcaaattcctttcgttaaccgcacaccagcttttcggtgtaagtatttgaatcttcagtcctttgtttcaatttctgaaaccctgtatgtgtcttatcgttgccctcctgatgtcgctatgcgtcttaattctcattaccttaaggaaaattctaaaaatggtttcaactttggcatgtcttcggctgtacgtaatcttgagaacacgtgtacgtatgtccacattcagaacgataacttcaacaaggaggctcatcgtgggaagaagattttggtcttcacccagggtgagaaaaccaagttgaagggctacggactggatgtgtctactgtgcacgaatatcaaggtaaggaagctgacgaaatcgttgtcgtccgactcgatccttataagactagcgaaatttatcttcgtttcaactatgcccttgttgccctgaccagacataaacgtaaactcacttattacacccgtgttcccaccgacgctttggctactctcattcgcgtgaatggtacaaccgtcaaagaactctattctcgcgaagaaattgaacagagcatccatgtgtcgatgggagcttgggaagatgttgagtttgacttcactcaatacactactcctaaatcctattcgtctttgaagactgttcaaacttccttaaaacacgtatcctcccataatcgaatctttttcgtccctcgtctcggtaaacattatcatagatcgaaaccctacttcatgtcatcacctgtacacattgttcgaaatttctatgggaaatttgatatctttttaacttcgaaattttcttgcaagaagaaaaccgacttgaatatgttgaaagagtctctatccgtcttagtcaaaaagaagtttttcgatgacggcactttattcttttgtgctgattctatcactgatgacttggattctgagattctgtcacacgttttattcaaacatgctaataattatcggttcgctttttgtatcaatgaatatcttgacgatatcccttctcaggttttcgaacttgaatgtatgaatggattttcttatattgataacaaagtgattactcgctgcgagacgaatgaatacgaaacccctattattttttctgaatctacttgttcatttgatattaatcatgctcaaatttttctgaacagtgtcttttctgacatttgctttatcgacttatcttttgatgagtacgacgtattcaattcagatatcaaccttgaacttggagatattacatattcccgaatttctgctcaaaattacgaatctccttatgagaatatgattcctaatctgcactccccttgcccttttgatcgtaaatataactaccgtgaaattttgttagctcttgaaaaaagaaatcgcaacgttccatattttaacggcgtcgttgactatgaccgtgtctcctctgaaatgcttgatgctttgttacgtgaatgtttcgacccgtatcgtctgagactcgcctgttctgatcctgtaaggattggttctggtgatattcattcgtggctaaagaagcaacctttagaagttcacgatcagattgttccatcttttgctatgcacaatgacgctcttaaccaatattccttctcgattaagaaacaagcaaaacctaatcttactgttgatgctgcatcttcttatgccgctcttcagacaattgtataccatgaaaaacatattaatgccgttttctgtacaatgttcactgagctaaagaaacgtgtccgttattctctccggaagaacgtaaaaattttttcggatatttcgacatctgatttcgaaaagatgttggactcggacattcctcccgaatcgctggatcctctcttggatcaccttgagattgatatcagtaagtacgacaagtctcaacgcgaattggctcttgaacttgaatgtaaaatacttcggcaatttggaatcgaagaggaacttgtccaattgtggtttaatgctcacattttgacttacatttatgacaaaaattcaaaattgaaagctgcgattccttatcagcgtaagagcggtgatgcgtctacttttattggcaacactctttttttaatggctgttattagccttcttattccagtttctcagatgtatctcgccctcttttccggtgacgattccctaatttacggttaccaccttaagaagtatatggacactcagcattttggtttaatgtttaatctcgaaataaaatttttccaatttctattatcttatttttgttcacgctttttgctaatcgtggacggtcattggacattcactcctgatccagttaaattgttcgtcaaactcggtcgacacaatttaattaaccctgctcacgtagaagaataccgtatcagtttgatcgacaattgtcgtggattcgaaaattcattgatttgtgaccacgtcgcaatggcggtctgtgagcgatatggtattataaataatttctctacgcttttttattctattccggatatgttgaagaaggagaatttccacactctttatactatccctaatggaaaaattaaccccaatacattcagtaattcctttgacttttaaactaatttcatttctaccatattcttctctaaaatgcttgtccttagaatcttcctctttttctatttgttgtcttttattcattcttccttaatgaagaatgagattctgtctaaacttaactctaggcagaatcgaatattttatcaaaaattcaaatttcattataatttttctgcctaccatccttctccttttgaatttgacccggaatgtatcgaagttcatcgcacacattcttggttctttcaaggttgtacacttcctccttcatgtggtgatgtacatacaaaaattctcgactcgtctttcggtttcaaagaattaatgtgttattcttttcataagtcccaaaacctttctcttgttaacatttctcccttttcctctttctctaaattcaattttacatttaaaaatcaattgaaagattatggatactttgaaactttagaaaacattgaacccgttgactttttcgagcattttttcttgtacgtccacaatggcttatattctttgctaccaaaaatttgtatagacaattatatcacccctggtcaaccctttccttcatccgtgttattttcttcgtctcatgatgacgtctgttttactcataatacgggtggtattaattgtgaattgaaactttttaaatcagttggtgagctttttatgcactataattttcctctgaaatttcgtaattcgcctttttctacccattcctatgagaaaacaggaaacaccgaaattcatgcaattgaaaattatcagcctttaaattctgtatatttacttgacaataatagtccttactcttattcagtatcatcttctgttcacctcactcctaccccttatgtgttacggtttcctattcacaattataatgggaagacccattgttttaaggttcattcaaaatatgtcaatcctttggcctctattttaaagttccttcttcagtctctcacgttaattttttctgaaataattaaagccttggaatttgtccttaaacccataattaacttggctttcaaatttttgaaagccctatatgacgaagtgtctgccttgtttaattctctcttgaattctataccgcaaattgatcatgtacttgacacgcttctcgtgtttgtcctttccttgatccattttcattattaccatgctatattgatctccttattgtacgttttaaacctattttatttctcttatatataatattttaaaaacgttcgaaatgagtacttcacgcattcctgtcccaaatggtgctaaacgccaaaaacccaatggtcaaacgcgagttcctgctccggttaaaaccgttgcagtagcccctcgacctcgtgtttatacgcctgtaaagacggtttcacctcaaaagaaatctaaatcttttgatttaggtgatgctacttctgacatttttaattcttttacatcagcattaaataagcctgctgtaattgttcttgtggctttggtcgccagtattgttcttacacaccagacttcattcgctacctctactatcggaaaatttttgaaagattccgataactctatcgctaaatggattcttaagaattcgaccaaatttctaggtatgttaatttttatacctgctctgtataacttaccttccaaattacgtcctgtaatttcaattgccaccgtcttttggtgccttttggttcctgaatcttcaatatatcagtacgtgattcaatccttttctctacacacttatttcaaagtgtctcagtccaatacccggcttttaattgtcggtattgttggtctttcttattatttaggatggttctccccatcactttctccagcaaaatcccccgcaacaaatggaacgggtgtataaccgcatccctgaagtcttttcttcaaaactcgtattttaggttcaaaattttcataactcccttccgtaatttcttttcttttattggttaaaaaaaaaaaaaaaaaaaaaaaaaaaaaaaaaaaaaaaaaaaaaaaaaaaa

SEQ ID NO: 16 - DNA, 9290 bp, unknown
  unknown virus
aataaacaaaccaaccaaaccaattttgaaagttttgacactacgagtcctgttaagctgcaaccccttaacatggctctcaactcgcaacaagttgacaacggagtagcaaccaactccattctttttgtgtctgaactctctaaacaactgaacgtagacatcgaccaaatacgttcagatctcgctgtcaaactgcttactcgttctgcggctgtaacctccgcatacgagaaccatgtagttgaaagcgtcaccgacactatcgcacattttaaaaatttgaacaaagaaattcatttgaatcaacgtctttctgatagtgaaaaaacaaggttgatgcaattgttttcccctccgtacaaactagtcttctcccgtaatcctactgacatcggtgcccatttgttttatcggtctttgaatgaaatcgccacttatcgttgttacgatttactcggcatagatgagcctgtacctattgggtatgatgtattgatcaaagaagtaggtgcatctgtcgctaaacttgtgaaatattgtcgtcctaacgttcatgcttgtactcctaatctgaactatgatgacacattgcgtttggccaacacagttagcactctagatcgctatatcaacccaaccggccaattttgccaaaaacgtcaacatttggctagattgtattctactgacccgatttttagatgttataacaaatcagaacattgttttattaaagccaaatacttggttttcgctcattctagttatgattgtacattgaccagtatggctaatatgatggattcagctctggcatttcgagccatgggttttattcattatagtcctaaaattttgtctaatttgaattctggctccgataatggattgaattggagattagaatgtaggtccatgtgtagtggaaaattgcattattctacaattggaaatcccgaagatatacctgacaaatattacatcacgttttggttcgataacgattatcaaaattcatatgtgcacgaattagatacgtacttgggtatcatacgcagttctatttgcacttctcgcaaaggaaatagttatatgattcggcgtctggaggaaataggaggattgctattttatgaaatcattaaaccttttcattcaataccttcatcattgattattcgtaacattcccctatcagatccagattccgtcattatacactattatagtctgcaaaatgatccaagcaagtatcactatcatgatttaattcccgctagattagttctcccgagaaaatttttcgaaaagctatattattatttgcaaagtcttccagaaggaaagtttactacccaaaatgctattatcatggcatctacaatggcgagtcgtacggttgttaatggtgcctatgtatcacaaccttatgatttatctgttgaagaaattgatatggctgcttatgccgtttatttcatcgtttattgtagacgttatgatttcatggaagtgttaaagaaattgaaaaattttgaagatttaaagcgcaatcccacactgtttaatcgcctcgcgtgtttgttccgtggtattaaaaactacatattatcttctacgtttgaggaatttacagaagaagtcgaattagaagatgtcactgataacgctaaagctcagattcgtaatgacatacatacgaaaatgacttataacatttttcaatggataatgcgtttatttcgcattaaaaatagatataatgttagattcattcccgtaactcgtgtcgttactattgaagaagacatagatgctattaaggcgatgaatacgactcttcctaaaattgtttccattccaaatccggctgaactcagagagacggtagctgaaaagttaaagattactcgagttgatgctgatgtttgtgaattgcgtgaagattattgttgtaaagctaatctctatgaatcgcggaacaattacgacaaatcttgtgtgttattgtgtttttgtaatcgtcgtaatatgacattacacgatttaaagcatactcttctgaattctacttatttcaacaatttgtttgtcacagctaaaatagctatgaagaatagtattgaaaatgctcgtgccgattcgaaaatatttgaattactagcgtgtgagtttcatgtaaatatttgtgtacattacgaaaccacttgtacttttcatgatgtgaaatctgtcacaacttatcatttttcagttaaagataaccattgcgtagaaatgcgtgagaagttaactattgcaccttttgaatttcctcacatgccagacttacccgcgattaccgatgattcgcctcttactcaagcttatcaacaacctgctgctgataaatataagatgcataaagtaactgtagatagttatagtcctttcgtctgtcgctctgctttgaaattacacgaaatggattcaacctacggtgtcattattcccggtaacgtttgtgagttgtcttgcgctccgggttcttggatgcaatatgtgcatatgaatttctctcagtctaaattgttttattctcactatgtagatggtcttgagttaaaatatgatcatgaggacatgacgtgtcttaatacgatcacagacggtgatttgaccgacttcgattgtattactgaaatcacccacatgattgaacgtaatgatcgtatggatgttgttctttctgatgccgcaatactgaaagctaacgaagactgtgttgacacagtaaagtttttcgaatatcaaaggatgttttttgctaacatatcgaactggttgaatgataagggaaacgtagtgttcaagtcatttgctgacgtgaaagtgtgctcggagatgaattgggctttaaatcattttgaaaatgtgattttttgtaagccaaatttttcttctccgatttccactgaatattacgttgtggctttgaatttcgatgccaacaaggaagttattgttccagtctcttattataactatccggttcttgttaaaaataaaacgattcaaacctgtaaatcgtttttaagaaaacaatttcctccacaaacgaaatatgtgttaccacagccagcttccatacatcctggcgttactcaacctcctcctagtgttaatattcctgtcaccccgatacctaatacagatgatgatgaacttcctgtagtcattcttccgatagacactttcgagactcgtattatcaaaaaattatcgactttagaacttcacgacgttactgttccgccatcgtgtaccgtagtacatgaacactctgatgttaatcccgatgtgttcattcaaatttccgatacacctttgatagcggacgaaatttcaaatgctatagtttatgatctccctatgttgagagttgaccttagcattgttcaacgtcgaaatgctttctcatacatatcctttattgctactaaaatcgctacatttaaacttcgtattgtcgttgatttgaccgcaattcaagatatagatgagataaagaaggttcaatcacatgtcgctactgaattcggtaaacatgaactcattattgtgtcaaattacacggattgtgcgtatcctatacatctctatgagaaatcaatcaatgagtatgtagcttataatcgctcgctccgtgcttcgaattcgaataactacaattttgtttatcgttctctatgtaataataactttcaggttacgcaatcatttttagccaatgtcgccgttaacaaacaaaatatgtccattttaatgggtaatgtctacaagtataagcaccctaacagaaaagatgagtatacacatgcctatgatggtgccgctggtaagttcttaccattcgatcaatgtacggatattaccaaacactatctcgtaggcgattatactcatcttatgtttgatgaaccgactgttgaagctgtttctcagattgatattgaacaattgaagaatgttcaatttgttttggttcaaggagttgcaggtcacggtaaaactcgtgaaattgtagaaaaacataaacccagtttgagaatgggcggcaaaggtgatttgattgtggctcctacgaaagctggtatcaatgtgttgtgggaaagaaccttggctcaccataagttggatgtcaacaatctcgacgtcaaatgttatcgcactgtttcatcatatttgctcaacaacaaaacggccaaacaacacgataccgtatttgttgatgaagcaattatgatgcatgttgcccaggttttagctgtggcttattatagcggtgctaaaacagtttacatgtatggtgattcagctcagattccagctcacagcgctcttggtgacttcgaatttttctatcattctccgcaatcgttatttactgccaaagccattagagacaagtcgtatcgtattccagctgatgttgcagcggcactagacccagagtatagagcttgtcacgcccgattcggctctaataccggtatcaagaccgctagcaccgtcattcgttctctaaaaatagttcgcattaatgacgtttcacagatgaagaatttttataatgaagatgttaagtatcttacttttactcacagcacctgtagtgaactcaagaaactggaccctaaatttgatcctaaaactgtcgctgcgtatcaaggctctgaacatcctagaattgctattgtacgtacctctgtttcggaagcagatcagatatataataatgctaatttgtgtgttaccgctcttactcggcacactaaagaactcacatattatacaatgtgtgataaagatgattacttgtcccgagtcatcaaacatgcattatcatgtactgatttaaatatcaaatcgttcagtaccagtgaaaatattggatccaccgtcgtttctacttttggttcagcaactgtgaataggttctttaaatctagacagaagttgacatcaagtttcacgatggttgatcataagcatatggtcactgaaaaagagtttgctacaagtttggtgggtattaggaacgatatattcgtcgataaatcagtctttaagaaattcgatatgggtgagatgattcgatggattaagaaactggctccacaagttaaagaagtttttgtgagagtgcgtagtgaaccattcgaatccaattcatccgttatcgacttggtagaggaatataaatgcgctaacacaatatcgactaccgttgccgagaaattggtagccgttgtcgaaccttatattcctgaaccgatacaattgactaattttattcgaatctctcctaacatcgaattattgcaaacttttatgagtcatttgtttcctaattctgtgtacatttctaaccaatttgatgcatattttgtgcataccaacgatattcattatacgttgaaggatgtatcattttccccgttatgggatagatacgctccttcatcttatgcttgtttgagaccggtgttgagcactcctgctccagctgttcgagatgtgtctcaacgtgaaatattgttgggtattcagaaacgtaatttgaacccacccgaacttatcgaaaacgtgtgttcggaagacgttgctgatcatctgatacaaaattttgcaaaaatgttggttcctggatatagaaaagtaatacatgaaatggaacctattcttcctaccacgagttctattgtttcgtggttggagagacaagacaggtcagtattgaagaatattcgaaacgatattcctatctgtcttcaaagtttgtctaattgttctttgtctctgaaacgtaatcctaaggttcgtatctctccaacagctatcgacatatacgattcagttcagactatcacgtgtcatcctaaatttattaacgcctacttttgttctattgttgaaatggcgcaggatcgtctcatgaagcttatgttgccgtatttcaaattttttaccaaatgtaccactgagaaatttggtgaagagtgttatgaaatatggagcaaatatggtaaattgtatttgttttctggtgacgattcgttgcttatcaacgggaatacattcaaggaaatggatatgagtaaatttgataaatctcaacttatttttgctctttcattcctgtgtaaggttttcgttaatttgggtgtaccaagttatgtggcccaattgtattatgaaatgatgtactatcgtatctgttcagatgttcataataaagttactatgttcctaactcctcaaatggaatctggatctgctgccacgtattttggtaacacgtgtttttgtgctgctgtcgttctgtctactttggatatgggtgatttttcttatacgccgagatttgaaaagttttcattgatgttcaatcttgaagtcaaagaattttcttacgttaatccgtatttttgttcaaaattcttggtcattgatgaaaaccgtatgaaattttaccctgatcccgtaaaaatactgataaaactaggtcgtgctgatttgaagaactataaacatcttcaagaatttcacactagtttgaaagatttagtttctcagtataattctctgttggatatagatatgatttctgccgctattcgtgaacgttatggttttccgtacgactgttcttttttgattcaaaatttaatttcactaattcaagacgataaattatttcctacattgttttatacattgccaggagatcgattggatttttctgctgtaagatttgtgaatgaataagttaaatatgctttagtcaattatcatcatgtttgcgtttttgctatttttgtccgccgtctcagctgtccctgaaaaatattttttgggttccttacctgctgtgctggaaccgttgctcgtacctaacgatcaacctggatatggtcccgtcaacaataaaccgttgtatgaactcgttttggatcgttacgtatacggtgaacttcatcaaccggattttcaagtttattcagccaatgcttggaacaaatttaccggaatcaagtgtcccgaacattatcatcattatgcacttgatcatcatttgttcactgaaatgtacgtttgtgtccgtgtgccgtcacctctacctaaacctcattcagtttataaaatatcacaactcggaaaaatttttagtacaatttgtgatcgtgtgaaaacatcatttcaagttgaactgattgattttgaacatttgagagtgattattcacaacaacggctcttggtttctttcatctgactattgtttaagtactatgttcagtgttgattctaaaggtggtgaaatgtttccagttaattataccatatcagacaataatgtattcgttcacatgcctcctgatgaatgttatccctggattgaaatcaccccgattccatcatatcctttcatcggtttgtatttgccgttgattggtgaaattaaagcaggtcgtcgatttcacgattgtattacaaaagtacattcgtatactccatatgacacttcagttggtattggtgtacatgaactgcccttatccgataacacgaatatgctttggaaggttgatattagtaatcatatatttacttctaaattgtattcgttttgggataggaaaatcaatgcaacgtacatttggtcttcggttaattacgtgcaatattatgaacctattgtatatcatgcagctgcggccgcctcatctagcccatttcgcattatatctaatataatcgtcgccgttattcggcccataattgacgttatactggatagtttgatgtatatatttgacagcatgcttgacatatttcattcacctgaatttttagaattgttcgatcgatttttgaatttcgttgttctaatttttaaatctatattatcatttattcgactaatattaattccaaaattaatacaaggctttatgtctgtaccatttaaatataagtttctattttttgtttgtctttttttgtatttgcgcactacaaaattcttgttctctgtgtgcgtttgtgctattctaagcgcatttttaaaagataagtaaattatagccttggtcaatttaaaatataaatgattcttacaatttgtgtcgtcgtactctttttgtatctttctgtggattgttaccatacctatctccttcggaaaaatggttatgcgtcgtactggtacggctgtgaagccaaaaactacggtgacgaaggctgtgtctgccccagtaacaaagaccccccgtgttagatctctttctaacggtactggtaaactcgacttcggtcggtttttcagctatgctactggcgttctcactgataccacgtttgtcttgttcttcattctttccgcctatttgtgctatgattataacaccggtggaaaccagtcccatatcgcgaagttcgtgacaaacttcgtcactcagttttcatcctttaagtctagtaagtgcaccattctcaatttgatcctcgttattgtgccgtttatacccgcgatatttaccgttacacctaaaaatcgttttggtgctatcgcgtgtacgtttttgtattacgtatttgtacctgaacgcactgtatacgagtatctaattcatggtgctattatctaccttattctccgtactaatgtccgtcaatatcgtatgatcggaatagttcttctatttttgtcatacgttatgcaatttactcttccccttccaacaggagctacgtataaatgtaactccactgtctccgttccaactgttgcagactcgtgatcgcatcttgcgtgaaggtagcgcctgattttcaggaaaactcaacagttgtcggagtttccattacacaggtttcttcctcgttcttcctgtgttgttctttgaacgagaatcggttatgcaatttactcttccccttccaacaggagctacgtataaatgtaactccactgtctccgttccaactgttgcagactcgtgatcgcatcttgcgtgaaggtagcgcctgattttcaggaaaactcaacagttgtcggagtttccattacacaggtttcttcctcgttcttcctgtgttgttctttgaacgagaatcggttatttcttgcccttataacccgggttttattatttttacctaaatttctattcctataatttctttattttcttattttacctcatttggcaaaaaaaaaaaaaaaaaaaaaaaaaaaaaaaa

SEQ ID NO: 17 - DNA, 6741 bp, unknown
  unknown virus
  CDS (1)..(6741)
atggctctcaactcgcaacaagttgacaacggagtagcaaccaactccattctttttgtgtctgaactctctaaacaactgaacgtagacatcgaccaaatacgttcagatctcgctgtcaaactgcttactcgttctgcggctgtaacctccgcatacgagaaccatgtagttgaaagcgtcaccgacactatcgcacattttaaaaatttgaacaaagaaattcatttgaatcaacgtctttctgatagtgaaaaaacaaggttgatgcaattgttttcccctccgtacaaactagtcttctcccgtaatcctactgacatcggtgcccatttgttttatcggtctttgaatgaaatcgccacttatcgttgttacgatttactcggcatagatgagcctgtacctattgggtatgatgtattgatcaaagaagtaggtgcatctgtcgctaaacttgtgaaatattgtcgtcctaacgttcatgcttgtactcctaatctgaactatgatgacacattgcgtttggccaacacagttagcactctagatcgctatatcaacccaaccggccaattttgccaaaaacgtcaacatttggctagattgtattctactgacccgatttttagatgttataacaaatcagaacattgttttattaaagccaaatacttggttttcgctcattctagttatgattgtacattgaccagtatggctaatatgatggattcagctctggcatttcgagccatgggttttattcattatagtcctaaaattttgtctaatttgaattctggctccgataatggattgaattggagattagaatgtaggtccatgtgtagtggaaaattgcattattctacaattggaaatcccgaagatatacctgacaaatattacatcacgttttggttcgataacgattatcaaaattcatatgtgcacgaattagatacgtacttgggtatcatacgcagttctatttgcacttctcgcaaaggaaatagttatatgattcggcgtctggaggaaataggaggattgctattttatgaaatcattaaaccttttcattcaataccttcatcattgattattcgtaacattcccctatcagatccagattccgtcattatacactattatagtctgcaaaatgatccaagcaagtatcactatcatgatttaattcccgctagattagttctcccgagaaaatttttcgaaaagctatattattatttgcaaagtcttccagaaggaaagtttactacccaaaatgctattatcatggcatctacaatggcgagtcgtacggttgttaatggtgcctatgtatcacaaccttatgatttatctgttgaagaaattgatatggctgcttatgccgtttatttcatcgtttattgtagacgttatgatttcatggaagtgttaaagaaattgaaaaattttgaagatttaaagcgcaatcccacactgtttaatcgcctcgcgtgtttgttccgtggtattaaaaactacatattatcttctacgtttgaggaatttacagaagaagtcgaattagaagatgtcactgataacgctaaagctcagattcgtaatgacatacatacgaaaatgacttataacatttttcaatggataatgcgtttatttcgcattaaaaatagatataatgttagattcattcccgtaactcgtgtcgttactattgaagaagacatagatgctattaaggcgatgaatacgactcttcctaaaattgtttccattccaaatccggctgaactcagagagacggtagctgaaaagttaaagattactcgagttgatgctgatgtttgtgaattgcgtgaagattattgttgtaaagctaatctctatgaatcgcggaacaattacgacaaatcttgtgtgttattgtgtttttgtaatcgtcgtaatatgacattacacgatttaaagcatactcttctgaattctacttatttcaacaatttgtttgtcacagctaaaatagctatgaagaatagtattgaaaatgctcgtgccgattcgaaaatatttgaattactagcgtgtgagtttcatgtaaatatttgtgtacattacgaaaccacttgtacttttcatgatgtgaaatctgtcacaacttatcatttttcagttaaagataaccattgcgtagaaatgcgtgagaagttaactattgcaccttttgaatttcctcacatgccagacttacccgcgattaccgatgattcgcctcttactcaagcttatcaacaacctgctgctgataaatataagatgcataaagtaactgtagatagttatagtcctttcgtctgtcgctctgctttgaaattacacgaaatggattcaacctacggtgtcattattcccggtaacgtttgtgagttgtcttgcgctccgggttcttggatgcaatatgtgcatatgaatttctctcagtctaaattgttttattctcactatgtagatggtcttgagttaaaatatgatcatgaggacatgacgtgtcttaatacgatcacagacggtgatttgaccgacttcgattgtattactgaaatcacccacatgattgaacgtaatgatcgtatggatgttgttctttctgatgccgcaatactgaaagctaacgaagactgtgttgacacagtaaagtttttcgaatatcaaaggatgttttttgctaacatatcgaactggttgaatgataagggaaacgtagtgttcaagtcatttgctgacgtgaaagtgtgctcggagatgaattgggctttaaatcattttgaaaatgtgattttttgtaagccaaatttttcttctccgatttccactgaatattacgttgtggctttgaatttcgatgccaacaaggaagttattgttccagtctcttattataactatccggttcttgttaaaaataaaacgattcaaacctgtaaatcgtttttaagaaaacaatttcctccacaaacgaaatatgtgttaccacagccagcttccatacatcctggcgttactcaacctcctcctagtgttaatattcctgtcaccccgatacctaatacagatgatgatgaacttcctgtagtcattcttccgatagacactttcgagactcgtattatcaaaaaattatcgactttagaacttcacgacgttactgttccgccatcgtgtaccgtagtacatgaacactctgatgttaatcccgatgtgttcattcaaatttccgatacacctttgatagcggacgaaatttcaaatgctatagtttatgatctccctatgttgagagttgaccttagcattgttcaacgtcgaaatgctttctcatacatatcctttattgctactaaaatcgctacatttaaacttcgtattgtcgttgatttgaccgcaattcaagatatagatgagataaagaaggttcaatcacatgtcgctactgaattcggtaaacatgaactcattattgtgtcaaattacacggattgtgcgtatcctatacatctctatgagaaatcaatcaatgagtatgtagcttataatcgctcgctccgtgcttcgaattcgaataactacaattttgtttatcgttctctatgtaataataactttcaggttacgcaatcatttttagccaatgtcgccgttaacaaacaaaatatgtccattttaatgggtaatgtctacaagtataagcaccctaacagaaaagatgagtatacacatgcctatgatggtgccgctggtaagttcttaccattcgatcaatgtacggatattaccaaacactatctcgtaggcgattatactcatcttatgtttgatgaaccgactgttgaagctgtttctcagattgatattgaacaattgaagaatgttcaatttgttttggttcaaggagttgcaggtcacggtaaaactcgtgaaattgtagaaaaacataaacccagtttgagaatgggcggcaaaggtgatttgattgtggctcctacgaaagctggtatcaatgtgttgtgggaaagaaccttggctcaccataagttggatgtcaacaatctcgacgtcaaatgttatcgcactgtttcatcatatttgctcaacaacaaaacggccaaacaacacgataccgtatttgttgatgaagcaattatgatgcatgttgcccaggttttagctgtggcttattatagcggtgctaaaacagtttacatgtatggtgattcagctcagattccagctcacagcgctcttggtgacttcgaatttttctatcattctccgcaatcgttatttactgccaaagccattagagacaagtcgtatcgtattccagctgatgttgcagcggcactagacccagagtatagagcttgtcacgcccgattcggctctaataccggtatcaagaccgctagcaccgtcattcgttctctaaaaatagttcgcattaatgacgtttcacagatgaagaatttttataatgaagatgttaagtatcttacttttactcacagcacctgtagtgaactcaagaaactggaccctaaatttgatcctaaaactgtcgctgcgtatcaaggctctgaacatcctagaattgctattgtacgtacctctgtttcggaagcagatcagatatataataatgctaatttgtgtgttaccgctcttactcggcacactaaagaactcacatattatacaatgtgtgataaagatgattacttgtcccgagtcatcaaacatgcattatcatgtactgatttaaatatcaaatcgttcagtaccagtgaaaatattggatccaccgtcgtttctacttttggttcagcaactgtgaataggttctttaaatctagacagaagttgacatcaagtttcacgatggttgatcataagcatatggtcactgaaaaagagtttgctacaagtttggtgggtattaggaacgatatattcgtcgataaatcagtctttaagaaattcgatatgggtgagatgattcgatggattaagaaactggctccacaagttaaagaagtttttgtgagagtgcgtagtgaaccattcgaatccaattcatccgttatcgacttggtagaggaatataaatgcgctaacacaatatcgactaccgttgccgagaaattggtagccgttgtcgaaccttatattcctgaaccgatacaattgactaattttattcgaatctctcctaacatcgaattattgcaaacttttatgagtcatttgtttcctaattctgtgtacatttctaaccaatttgatgcatattttgtgcataccaacgatattcattatacgttgaaggatgtatcattttccccgttatgggatagatacgctccttcatcttatgcttgtttgagaccggtgttgagcactcctgctccagctgttcgagatgtgtctcaacgtgaaatattgttgggtattcagaaacgtaatttgaacccacccgaacttatcgaaaacgtgtgttcggaagacgttgctgatcatctgatacaaaattttgcaaaaatgttggttcctggatatagaaaagtaatacatgaaatggaacctattcttcctaccacgagttctattgtttcgtggttggagagacaagacaggtcagtattgaagaatattcgaaacgatattcctatctgtcttcaaagtttgtctaattgttctttgtctctgaaacgtaatcctaaggttcgtatctctccaacagctatcgacatatacgattcagttcagactatcacgtgtcatcctaaatttattaacgcctacttttgttctattgttgaaatggcgcaggatcgtctcatgaagcttatgttgccgtatttcaaattttttaccaaatgtaccactgagaaatttggtgaagagtgttatgaaatatggagcaaatatggtaaattgtatttgttttctggtgacgattcgttgcttatcaacgggaatacattcaaggaaatggatatgagtaaatttgataaatctcaacttatttttgctctttcattcctgtgtaaggttttcgttaatttgggtgtaccaagttatgtggcccaattgtattatgaaatgatgtactatcgtatctgttcagatgttcataataaagttactatgttcctaactcctcaaatggaatctggatctgctgccacgtattttggtaacacgtgtttttgtgctgctgtcgttctgtctactttggatatgggtgatttttcttatacgccgagatttgaaaagttttcattgatgttcaatcttgaagtcaaagaattttcttacgttaatccgtatttttgttcaaaattcttggtcattgatgaaaaccgtatgaaattttaccctgatcccgtaaaaatactgataaaactaggtcgtgctgatttgaagaactataaacatcttcaagaatttcacactagtttgaaagatttagtttctcagtataattctctgttggatatagatatgatttctgccgctattcgtgaacgttatggttttccgtacgactgttcttttttgattcaaaatttaatttcactaattcaagacgataaattatttcctacattgttttatacattgccaggagatcgattggatttttctgctgtaagatttgtgaatgaataa

SEQ ID NO: 18 - protein, 2246 aa, unknown
  Synthetic Construct
MALNSQQVDNGVATNSILFVSELSKQLNVDIDQIRSDLAVKLLTRSAAVTSAYENHVVESVTDTIAHFKNLNKEIHLNQRLSDSEKTRLMQLFSPPYKLVFSRNPTDIGAHLFYRSLNEIATYRCYDLLGIDEPVPIGYDVLIKEVGASVAKLVKYCRPNVHACTPNLNYDDTLRLANTVSTLDRYINPTGQFCQKRQHLARLYSTDPIFRCYNKSEHCFIKAKYLVFAHSSYDCTLTSMANMMDSALAFRAMGFIHYSPKILSNLNSGSDNGLNWRLECRSMCSGKLHYSTIGNPEDIPDKYYITFWFDNDYQNSYVHELDTYLGIIRSSICTSRKGNSYMIRRLEEIGGLLFYEIIKPFHSIPSSLIIRNIPLSDPDSVIIHYYSLQNDPSKYHYHDLIPARLVLPRKFFEKLYYYLQSLPEGKFTTQNAIIMASTMASRTVVNGAYVSQPYDLSVEEIDMAAYAVYFIVYCRRYDFMEVLKKLKNFEDLKRNPTLFNRLACLFRGIKNYILSSTFEEFTEEVELEDVTDNAKAQIRNDIHTKMTYNIFQWIMRLFRIKNRYNVRFIPVTRVVTIEEDIDAIKAMNTTLPKIVSIPNPAELRETVAEKLKITRVDADVCELREDYCCKANLYESRNNYDKSCVLLCFCNRRNMTLHDLKHTLLNSTYFNNLFVTAKIAMKNSIENARADSKIFELLACEFHVNICVHYETTCTFHDVKSVTTYHFSVKDNHCVEMREKLTIAPFEFPHMPDLPAITDDSPLTQAYQQPAADKYKMHKVTVDSYSPFVCRSALKLHEMDSTYGVIIPGNVCELSCAPGSWMQYVHMNFSQSKLFYSHYVDGLELKYDHEDMTCLNTITDGDLTDFDCITEITHMIERNDRMDVVLSDAAILKANEDCVDTVKFFEYQRMFFANISNWLNDKGNVVFKSFADVKVCSEMNWALNHFENVIFCKPNFSSPISTEYYVVALNFDANKEVIVPVSYYNYPVLVKNKTIQTCKSFLRKQFPPQTKYVLPQPASIHPGVTQPPPSVNIPVTPIPNTDDDELPVVILPIDTFETRIIKKLSTLELHDVTVPPSCTVVHEHSDVNPDVFIQISDTPLIADEISNAIVYDLPMLRVDLSIVQRRNAFSYISFIATKIATFKLRIVVDLTAIQDIDEIKKVQSHVATEFGKHELIIVSNYTDCAYPIHLYEKSINEYVAYNRSLRASNSNNYNFVYRSLCNNNFQVTQSFLANVAVNKQNMSILMGNVYKYKHPNRKDEYTHAYDGAAGKFLPFDQCTDITKHYLVGDYTHLMFDEPTVEAVSQIDIEQLKNVQFVLVQGVAGHGKTREIVEKHKPSLRMGGKGDLIVAPTKAGINVLWERTLAHHKLDVNNLDVKCYRTVSSYLLNNKTAKQHDTVFVDEAIMMHVAQVLAVAYYSGAKTVYMYGDSAQIPAHSALGDFEFFYHSPQSLFTAKAIRDKSYRIPADVAAALDPEYRACHARFGSNTGIKTASTVIRSLKIVRINDVSQMKNFYNEDVKYLTFTHSTCSELKKLDPKFDPKTVAAYQGSEHPRIAIVRTSVSEADQIYNNANLCVTALTRHTKELTYYTMCDKDDYLSRVIKHALSCTDLNIKSFSTSENIGSTVVSTFGSATVNRFFKSRQKLTSSFTMVDHKHMVTEKEFATSLVGIRNDIFVDKSVFKKFDMGEMIRWIKKLAPQVKEVFVRVRSEPFESNSSVIDLVEEYKCANTISTTVAEKLVAVVEPYIPEPIQLTNFIRISPNIELLQTFMSHLFPNSVYISNQFDAYFVHTNDIHYTLKDVSFSPLWDRYAPSSYACLRPVLSTPAPAVRDVSQREILLGIQKRNLNPPELIENVCSEDVADHLIQNFAKMLVPGYRKVIHEMEPILPTTSSIVSWLERQDRSVLKNIRNDIPICLQSLSNCSLSLKRNPKVRISPTAIDIYDSVQTITCHPKFINAYFCSIVEMAQDRLMKLMLPYFKFFTKCTTEKFGEECYEIWSKYGKLYLFSGDDSLLINGNTFKEMDMSKFDKSQLIFALSFLCKVFVNLGVPSYVAQLYYEMMYYRICSDVHNKVTMFLTPQMESGSAATYFGNTCFCAAVVLSTLDMGDFSYTPRFEKFSLMFNLEVKEFSYVNPYFCSKFLVIDENRMKFYPDPVKILIKLGRADLKNYKHLQEFHTSLKDLVSQYNSLLDIDMISAAIRERYGFPYDCSFLIQNLISLIQDDKLFPTLFYTLPGDRLDFSAVRFVNE

SEQ ID NO: 19 - DNA, 9266 bp, unknown
  unknown virus
aattaacaaactatacagacttacgtctcgtgatttgttcacgattgtagcgattgttcatttggagcgttgaagaactccaagtaactattgtgagctttcaaaaactctcatcgtgtattgtgaataaatcatagttaagctaaattcatctgagttgacttatatagctgttataaccccggttgtatatttcgtttaaacccgtttacgactcagataaaatggccgatcatgatgaagccgcaaccagatcgctgcttttcatctctgagatggccaaacatttggaaattagtactgaagacgttagatcagaattaggaagtaagttattatcacgatccacagccatcacgtcccaatacgaagatcacgtcgtaagtaacgttttggaacggataactaattttaaggaattgtccaaagaaatctacatagatcaacgactgtccgatgcggaaaaaactaaacttatgcagttgtggtcccctccgtataagctaaaattttctaaaaattctaaggacattggtgcgcacatgtattatcgttcgatgaatgagatcgctacgtacagatgctacgacttgatttgtggcaaagagaaaaacgctccggttaaccgagatgtgttagtgaaggaagttggtgctgccgtttgcaagatcgtaaaatataatcgcaacagcgtacacgcttgtactccgaatctaactatcgatgacaccttgcgtatttctaatacacagagatctctcgaatctataatccatgaccctacttctccgcctcatctcgtggaaaaagccaaaagatatcaatcctctggaaagtataggtgttttaggaaatcacaacactgtaaaatttcttcaaaatttttggtccttgctcactgcgcgtacgattgcacgcttcgccagattgctaacatgatggaatctgctggtgctgtacgtggaattggatttatccatttctcccagaaaattctgtcgaatctggtcgaaggcagtgacaatggccttaattggaaaattgagtgtcgcacctatattgattcccggaggaattttggtgaattgggaaaccttgccggacatgccgttagtctgtacaatagctttcgcaacaaatccgaccggataatgaataatatcaatcacagggatttcgtgataaaattttggttcgataatgattaccaaaattcgtacgttcacgacctggacacgtacttgggtattattcgtaagtccgtttgcgaagctgataatggacaaacgtttatgattcagcgtaaagaggagatcggtggtttgctgtttttcgaaatcattcgtcccaccatcgacatcccgccttgtgtaattcataggatgcttccgttttctgaacccgaagacatcattatacattactataggctgcagaatgatccgcaaggctaccactaccacgatttggttccggaaaggttagtgtgccctaaaaaattttttgaaaaattgtattattatctcttttgtttgcccgaaggaaagttcaccgttcagaacgcggttatcatggcttctaccatggcgtctcgcacggttatcaacggcacttcggtttcacagccgtataatttgtcaataaacgtaatcgacaaagtttcacatgccgcttacttcattgtgtactgtcgtcgttacgatttgatgcttaccttgaagaaactgaagaatttcgaagatatccgtcggaatcccaccatgtataatcgtttgtgcgttttgttgcgcagagttcgcaattatgttgtcggagcaccgttcgaagatttgaaaactgaatccacattcgacgacgctgtagacaacgctacatgctctgaagctaacgaaattgctactaaacactcgctcaatataatacagtggatgatgaaacttttccgagtaaacaacagatacaaagttgattttttccccataactcgcgttgtgtctattgaagaagacattcaaaccttcaaggcagtcgaattcggtttgcctaagttcgacgaacctgtagatgatgattcgttgcgtaaaatcataaaggaaaaactgcacattgatcacgttgatgttgacaagtgtactgtctctgacactccgtgtaagtgtgaccttgtaccgtaccacaataattacgagaaacgatgcgttttgctctgcttctgcaacaaacgcaacatttcccttaatgaattgcaactcagcttgtacaaatcgaaatatttcgaagctcttttctcgactaccaaaaccaaataccacgagagtattttcggggataaagccgatatcattttgttcgagctgattgcgtgcgtttacaatgttaacatttgccttcacacggagctgaaagagatattccacgacgtacgatctgatgaaacgtatcactttatgattaaagataaccattgctatgaactgagagaaaaaccttcagtcagacccttcgagtttctgcctgttcccgacaaagtaaatttgttgcagaacaatttgcgcgaagcttactcccgaccgaaggcagaaaagtataaactccgtagcgtggttgtcgatgatcatcatccgtacgtgtgtcgatctgcactgaagttactagaaatcgatggtagctatggtgtcgtgaagcacggcaacgtctgtgaaatctcggccgctcccggatcttggattcaatactgtcacataaatcattctcattctaaactattttacacctattttatagaaggtaatgattttctgtatgaccatgaagatctaaattgcttatgtgaatccacttctggtgatgttactagtcctgaatttttccaatgctttactgttgaagctgaaaaatccggccgatttgatacattgttgtccgatgctgtaataatgtcttctacggaagatcatgtagatgtcgaaaggtttacgaattatcagaacgcattcttcctgaatttgaaagaatgggtgcgtgataatggtaatatcgtatttaagtctttcgctgacatttctatttctgacaccgtcaatactgtcttgaaccatttcgagaacgtttacttcgtaaaacctaatttttctgctgcactctctaccgagtactatataattggaaagaactttttacccgaaacggcggacgaaattcctgagcgaaaattcttttctattccttcattggttatgaataaggtgcttcgtactgctaacctgttcttgaaaggaaaatatcctcctcagaagaagtttgtgctccccgccgtgaatccctccgtcactacgtttcccgacgtacccgcaccctcggctcctgttgaaattgctgaggatcttgcggtgttacctaacgaaaacgattcgtttgaggataaggtgcaaaaagttatcaattctttggaattttttgacgttgacagagcggacattgaaatcgtccatgaagacactgaatcgtttcaccacgttcatgatgtcgaaatcagtcttcatgattctgcgatgctcggtgaaagaaatgattacataattcacccgtgtcccgcattgaaaattgacatgagtgttgtgaattactctgaagccgttgctcgcatccactctgtctcgtacaagatcaatagtttccgtcttaaagtgaaatttgacttgactggcgtttcggacgaaaccgtttcgtcttctttgctgactcacattaaagaacgatattcgagacacaaacttttgatccgcactaactatcgggagtgttctgttaatatctctgccttcgaaaaaagcacgaccgaatatattgcgtacacacgtctagtgaaatcgtgcaatctcagcacttaccgccactggtatggtcagttgaaaatgaacgatttcgtagtttctatgactattcgtcgtaacgtttctatggatacgcaaaatatatcgtacatgcaaggttgtgattttcgattcaaacatgagaaatctcaggacgaatacacccattgttattgcggtgaaactgattgtttcataccgttcgacgaaaaattacctgaccgatggtatctggttggtgattatacggcgaaaatgtttgacgacgctctagtcgaaaaagtagcccgcatagatctgtcgaagttgaaagatgtccagttcgtcttagtacagggtgttgctggtcacggtaagacccacgaaattgtctccaaacacacgcctagcctgagatcgtgtcgtggagatcttttagtcaccccaacaattgccggaaagaaagtaatcatggaacgtaccgcaaatttacataagttagaaattgattcgttggatatttcttcttatcgtacggttacctccttcttggttaagcccacggtgcacaagtacaacactgtgtacttcgatgaagctattatggtgcacgttgctcttgttatagctgtggcgtactattccggcgcgaaaactgtatatatgtatggtgacgtggctcagatccctgcacatagtcgacttggcagctttgacttcaactatcatgctccccagaaattattcaacgcacagcacattaggaacaaatcgtatcgaattcctgctgacgttgccgccgccctgaaccccgtgtacgttgattgccattcccaatttggacagagtacaggtattactactgttagtactgttgctagatctctaaatgtggttttgattaacgatgtctccgaaatgaaacgtcattaccgagaaggcgtaaaatacttggcgtttacgcacaccactgctaacgaattaaacagattaagcagtgagttttccgcctcgacgatagccgcgtttcaaggttcggagtctaaggaggtcgctattgtgagaacgtctgtgtctgaagcagatcaaatgtacaacaacattaatttgtgcgttactgctctgactaggcacacactcaaactgacgtattatacttgttgtcacaaaggtgatttcttgaagaaaactatcgaatccacgaaggcgttgtcagatctcgccataaaaaattttagcacctctattaacgccggttctgtaacgaataacgagtatgtaccgatgatcgataaaccatccgtttctaggtttttcaagtctagggaaaaatattctcattcgtttactattgtagaacatgaaaacgtagtatcggaaaaagaattcgcgtacaaattgtctaagatcaataacgatatttttgtccgcaaatcgatattcaaaaagttttctatgtcggaacttgcgaagtggattagaaaaatatcgccacatataaagcaagtctacgtgaaagtctacaacgaaccgtttgaaaataatccgataataatcgacatcgctgaagagtataaggtgcgtaatgccctgaccaccgaagtttctgagcatttggaaccgattaatgaggttgagcttattacaccgattcccgtttacccatgcatgcaattgaaaccttgcctagaaactttgcgtgaatttatgtcttcattgtatcctgatcagatgtacgtaaacacggattttgatgcctactttgtccacacgaatgacattgattacacactgtcggacaccactctttcgatgttatgggataggccgcacgttcgtaagtatgattgtctgaccccgtggttgagcactcctgctcccgcaagacgcgatgtttcgtttcgtgagatccttctgggtcttatgaagcgtaacatgaatccaccgcaaatgctcgaaaacaccgctcccgatgatgcggctatgcacttaatgcagagcattagtagtaaagcgtttatacgtggttggaaatctgtgattagtgaaatgttacctattgtgcccactactgaatctattgtgcgttggttggaaaaacaagaccgatctgttttaaagtcaatgatgcatgacattccactttggattgccactattacgagatgttcactgtctctgaaacgcaatcccaaagttcgtattactccgaatgccatctccatctatgactcagtacagacgatcacgtgtcacccaaaattcttgaatgcatacttttgcccgataattgacgaagtcatggaccgtttccgaaaagttttgctgccttggttccttatttacacgaaagaaaatactgaatctttttccgttaaatgtagtagagcttacgcaaaatacgggaaactgggtctgtttgccggtgacgattcgtttttgatcaacggtataaagatgaaggaagcggacattagtaagtgtgataaatcggaattacttttggcactaaaatttttatgcatgttgctagagaactttggtgtacccgaaccgtccgtagcgttatactattgtatgatgtattatcgcatttgctctgacccttcgaataagattaccgtttcgttcacccctcagatggaatccggttcacccgcaacttttttcggtaacaccacgtattgtatggccgtcatattgtctgtcgtcgatttcgaaacgtttgaatatacaccaagattcgaaaaattttcaatgatgttcaatttggaagtaaaagaattcaagtatgacaacccgtatttttgttcgaaatttattgtcattgacgatctccggttcaaatttttacctgatcctgtaaagatattgataaaacttggccgtaaggatttgaagaacttttcacatcttaaggaatttcatacaagtttaaaggatcttgtggcagaatataaatgtgtaatggacatttccgtcgtttctcttgctgttcaagaacgatacggatttccgttcgattgttccaattttatctcgaatatgattgcggtcattaatgacgaaacatcattcaatgcattgttcacagcgttgccgggtgcgatattggaccttaaggccactagattttcagaagattaagctttgggtaatcatgtttattcctattattattctgtctttcattcgcgcttgcctttcggctcgcggcacttttgaccttcctcagctctcccgttacagggatgagttggaataccctaatcgtcctaatactcaccctttgatacgattggatttcgaatcacatttatatgacgggaatataatgcacgaattttccgttcatagtgccaatgcctggaatatgatctggggtctgaaatgccctcctggtcacattgtgcaccctattgatcaccacttgttttcggaactctatgtgtgtattgccgtacctcacaagatgaaaattatgtatgaatccttcaaattgtcctctccggaaagtaatttctttttaccatacggcatttcgtcaggcgctttcgcctccgttacagtgcccggaattcaaaactaccgtgttttgaaagacgaatttaatgactattacctttcaacggtgttttgtttatcgcattattatcagactgatattaacggaaaagacaaatttttcttgaattatacggttactgattccaccattacttttagagtaccttcaaaattatgtaaaattcaaaaattgtataatgacacatttaatttaggtactctacccctcactgttatcattgaatctgcctcgttggagttgatagacagcattagagatgatagaggtgctggttgtcctggttctaagccattcaccgaattaccttttgacgatcagtcacttctcatttataatgttacgtctaaaggtggcaagggctgttccgccatttacgttaaaccgtttaagtttggtacagtcacttatcacattaactccgctatttcgaattcaccgatcaacacgatcgttactatccttgtatctgtcataactcccattattgatactattttaaatttgttgaccaatattatttctagtctaattgatatatttgaaagtcctgaatttttgcgcattcttgacagactatttacttttattgtaaatgtatttgtattaattttacagtttgttagaaatgtaattattccgaaaatagttgattttctatattctattcctagaaaatataaaattttatcttttgtaacattcgtcttatatctaaagaccactaaatttatttactctttgtgtgttaccgcgatagtgggattttgtatgatagaatagtaagatttggctaatcaattcaatgtctattgtaattttattgccgttattaacgtatcttatttacctagtttatcaccctagatttatctacgatctaactatcatatacttaatatcatatttaatcattaaatttattgattctatcgtgaatcaccttactcgtaacgatggttctgcgtcgtactggcacggttgtactgccgaattctatgaagccgaagactgcgtctgcccaaaagccgaagaaatctcggttctcagacatggaattgagtaaagttgccgactaccttgtttcaaaatacaatgggaaagggggacagatgaaaaagaacggtgatgctgacttcaatttggaacgtctttttgattacgtttataagaccttgtctaacgtaacattcttgatgttctttgccaccgctgcgtacctttgttacaattacactacctcgggggagaaatcccacttggttgtttttgctaacaaccttacgtctaaatttccgtctcttaacccctccaaatgtagcattttggaatttgtgttggtgctcattcctttcgcccctgctattctttcggtcgataaaaagaaacgcgtgcctgctctcgtgtttacggttctgtactacatttttgtgcctgaaagaaccgtctacgagtaccttattcacggtctcataatatatcttatcattaaggctaacgatcaaaaatttaaactaattggctttgttgctttgtttttgtcgtatgtcatgcagtttgctatccctctcccttctggaacgggatacaattgcacggctgtagctacgggattttcccttacgccgaactccacaggagatgtaggccagtgaagttgagccttttgcgaaacttctatacccgaacttcgcgtccttctgacgtgaagatgtaggaagaggcaccgtttgccccggtgtcttgggctgtttttgcctaaacaaatttcttatttttcttattaatttcttacaattggcaaaaaaaaaaaaaaaaaaaaaaaaaaa

SEQ ID NO: 20 - DNA, 6774 bp, unknown
  unknown virus
  CDS (1)..(6774)
atggccgatcatgatgaagccgcaaccagatcgctgcttttcatctctgagatggccaaacatttggaaattagtactgaagacgttagatcagaattaggaagtaagttattatcacgatccacagccatcacgtcccaatacgaagatcacgtcgtaagtaacgttttggaacggataactaattttaaggaattgtccaaagaaatctacatagatcaacgactgtccgatgcggaaaaaactaaacttatgcagttgtggtcccctccgtataagctaaaattttctaaaaattctaaggacattggtgcgcacatgtattatcgttcgatgaatgagatcgctacgtacagatgctacgacttgatttgtggcaaagagaaaaacgctccggttaaccgagatgtgttagtgaaggaagttggtgctgccgtttgcaagatcgtaaaatataatcgcaacagcgtacacgcttgtactccgaatctaactatcgatgacaccttgcgtatttctaatacacagagatctctcgaatctataatccatgaccctacttctccgcctcatctcgtggaaaaagccaaaagatatcaatcctctggaaagtataggtgttttaggaaatcacaacactgtaaaatttcttcaaaatttttggtccttgctcactgcgcgtacgattgcacgcttcgccagattgctaacatgatggaatctgctggtgctgtacgtggaattggatttatccatttctcccagaaaattctgtcgaatctggtcgaaggcagtgacaatggccttaattggaaaattgagtgtcgcacctatattgattcccggaggaattttggtgaattgggaaaccttgccggacatgccgttagtctgtacaatagctttcgcaacaaatccgaccggataatgaataatatcaatcacagggatttcgtgataaaattttggttcgataatgattaccaaaattcgtacgttcacgacctggacacgtacttgggtattattcgtaagtccgtttgcgaagctgataatggacaaacgtttatgattcagcgtaaagaggagatcggtggtttgctgtttttcgaaatcattcgtcccaccatcgacatcccgccttgtgtaattcataggatgcttccgttttctgaacccgaagacatcattatacattactataggctgcagaatgatccgcaaggctaccactaccacgatttggttccggaaaggttagtgtgccctaaaaaattttttgaaaaattgtattattatctcttttgtttgcccgaaggaaagttcaccgttcagaacgcggttatcatggcttctaccatggcgtctcgcacggttatcaacggcacttcggtttcacagccgtataatttgtcaataaacgtaatcgacaaagtttcacatgccgcttacttcattgtgtactgtcgtcgttacgatttgatgcttaccttgaagaaactgaagaatttcgaagatatccgtcggaatcccaccatgtataatcgtttgtgcgttttgttgcgcagagttcgcaattatgttgtcggagcaccgttcgaagatttgaaaactgaatccacattcgacgacgctgtagacaacgctacatgctctgaagctaacgaaattgctactaaacactcgctcaatataatacagtggatgatgaaacttttccgagtaaacaacagatacaaagttgattttttccccataactcgcgttgtgtctattgaagaagacattcaaaccttcaaggcagtcgaattcggtttgcctaagttcgacgaacctgtagatgatgattcgttgcgtaaaatcataaaggaaaaactgcacattgatcacgttgatgttgacaagtgtactgtctctgacactccgtgtaagtgtgaccttgtaccgtaccacaataattacgagaaacgatgcgttttgctctgcttctgcaacaaacgcaacatttcccttaatgaattgcaactcagcttgtacaaatcgaaatatttcgaagctcttttctcgactaccaaaaccaaataccacgagagtattttcggggataaagccgatatcattttgttcgagctgattgcgtgcgtttacaatgttaacatttgccttcacacggagctgaaagagatattccacgacgtacgatctgatgaaacgtatcactttatgattaaagataaccattgctatgaactgagagaaaaaccttcagtcagacccttcgagtttctgcctgttcccgacaaagtaaatttgttgcagaacaatttgcgcgaagcttactcccgaccgaaggcagaaaagtataaactccgtagcgtggttgtcgatgatcatcatccgtacgtgtgtcgatctgcactgaagttactagaaatcgatggtagctatggtgtcgtgaagcacggcaacgtctgtgaaatctcggccgctcccggatcttggattcaatactgtcacataaatcattctcattctaaactattttacacctattttatagaaggtaatgattttctgtatgaccatgaagatctaaattgcttatgtgaatccacttctggtgatgttactagtcctgaatttttccaatgctttactgttgaagctgaaaaatccggccgatttgatacattgttgtccgatgctgtaataatgtcttctacggaagatcatgtagatgtcgaaaggtttacgaattatcagaacgcattcttcctgaatttgaaagaatgggtgcgtgataatggtaatatcgtatttaagtctttcgctgacatttctatttctgacaccgtcaatactgtcttgaaccatttcgagaacgtttacttcgtaaaacctaatttttctgctgcactctctaccgagtactatataattggaaagaactttttacccgaaacggcggacgaaattcctgagcgaaaattcttttctattccttcattggttatgaataaggtgcttcgtactgctaacctgttcttgaaaggaaaatatcctcctcagaagaagtttgtgctccccgccgtgaatccctccgtcactacgtttcccgacgtacccgcaccctcggctcctgttgaaattgctgaggatcttgcggtgttacctaacgaaaacgattcgtttgaggataaggtgcaaaaagttatcaattctttggaattttttgacgttgacagagcggacattgaaatcgtccatgaagacactgaatcgtttcaccacgttcatgatgtcgaaatcagtcttcatgattctgcgatgctcggtgaaagaaatgattacataattcacccgtgtcccgcattgaaaattgacatgagtgttgtgaattactctgaagccgttgctcgcatccactctgtctcgtacaagatcaatagtttccgtcttaaagtgaaatttgacttgactggcgtttcggacgaaaccgtttcgtcttctttgctgactcacattaaagaacgatattcgagacacaaacttttgatccgcactaactatcgggagtgttctgttaatatctctgccttcgaaaaaagcacgaccgaatatattgcgtacacacgtctagtgaaatcgtgcaatctcagcacttaccgccactggtatggtcagttgaaaatgaacgatttcgtagtttctatgactattcgtcgtaacgtttctatggatacgcaaaatatatcgtacatgcaaggttgtgattttcgattcaaacatgagaaatctcaggacgaatacacccattgttattgcggtgaaactgattgtttcataccgttcgacgaaaaattacctgaccgatggtatctggttggtgattatacggcgaaaatgtttgacgacgctctagtcgaaaaagtagcccgcatagatctgtcgaagttgaaagatgtccagttcgtcttagtacagggtgttgctggtcacggtaagacccacgaaattgtctccaaacacacgcctagcctgagatcgtgtcgtggagatcttttagtcaccccaacaattgccggaaagaaagtaatcatggaacgtaccgcaaatttacataagttagaaattgattcgttggatatttcttcttatcgtacggttacctccttcttggttaagcccacggtgcacaagtacaacactgtgtacttcgatgaagctattatggtgcacgttgctcttgttatagctgtggcgtactattccggcgcgaaaactgtatatatgtatggtgacgtggctcagatccctgcacatagtcgacttggcagctttgacttcaactatcatgctccccagaaattattcaacgcacagcacattaggaacaaatcgtatcgaattcctgctgacgttgccgccgccctgaaccccgtgtacgttgattgccattcccaatttggacagagtacaggtattactactgttagtactgttgctagatctctaaatgtggttttgattaacgatgtctccgaaatgaaacgtcattaccgagaaggcgtaaaatacttggcgtttacgcacaccactgctaacgaattaaacagattaagcagtgagttttccgcctcgacgatagccgcgtttcaaggttcggagtctaaggaggtcgctattgtgagaacgtctgtgtctgaagcagatcaaatgtacaacaacattaatttgtgcgttactgctctgactaggcacacactcaaactgacgtattatacttgttgtcacaaaggtgatttcttgaagaaaactatcgaatccacgaaggcgttgtcagatctcgccataaaaaattttagcacctctattaacgccggttctgtaacgaataacgagtatgtaccgatgatcgataaaccatccgtttctaggtttttcaagtctagggaaaaatattctcattcgtttactattgtagaacatgaaaacgtagtatcggaaaaagaattcgcgtacaaattgtctaagatcaataacgatatttttgtccgcaaatcgatattcaaaaagttttctatgtcggaacttgcgaagtggattagaaaaatatcgccacatataaagcaagtctacgtgaaagtctacaacgaaccgtttgaaaataatccgataataatcgacatcgctgaagagtataaggtgcgtaatgccctgaccaccgaagtttctgagcatttggaaccgattaatgaggttgagcttattacaccgattcccgtttacccatgcatgcaattgaaaccttgcctagaaactttgcgtgaatttatgtcttcattgtatcctgatcagatgtacgtaaacacggattttgatgcctactttgtccacacgaatgacattgattacacactgtcggacaccactctttcgatgttatgggataggccgcacgttcgtaagtatgattgtctgaccccgtggttgagcactcctgctcccgcaagacgcgatgtttcgtttcgtgagatccttctgggtcttatgaagcgtaacatgaatccaccgcaaatgctcgaaaacaccgctcccgatgatgcggctatgcacttaatgcagagcattagtagtaaagcgtttatacgtggttggaaatctgtgattagtgaaatgttacctattgtgcccactactgaatctattgtgcgttggttggaaaaacaagaccgatctgttttaaagtcaatgatgcatgacattccactttggattgccactattacgagatgttcactgtctctgaaacgcaatcccaaagttcgtattactccgaatgccatctccatctatgactcagtacagacgatcacgtgtcacccaaaattcttgaatgcatacttttgcccgataattgacgaagtcatggaccgtttccgaaaagttttgctgccttggttccttatttacacgaaagaaaatactgaatctttttccgttaaatgtagtagagcttacgcaaaatacgggaaactgggtctgtttgccggtgacgattcgtttttgatcaacggtataaagatgaaggaagcggacattagtaagtgtgataaatcggaattacttttggcactaaaatttttatgcatgttgctagagaactttggtgtacccgaaccgtccgtagcgttatactattgtatgatgtattatcgcatttgctctgacccttcgaataagattaccgtttcgttcacccctcagatggaatccggttcacccgcaacttttttcggtaacaccacgtattgtatggccgtcatattgtctgtcgtcgatttcgaaacgtttgaatatacaccaagattcgaaaaattttcaatgatgttcaatttggaagtaaaagaattcaagtatgacaacccgtatttttgttcgaaatttattgtcattgacgatctccggttcaaatttttacctgatcctgtaaagatattgataaaacttggccgtaaggatttgaagaacttttcacatcttaaggaatttcatacaagtttaaaggatcttgtggcagaatataaatgtgtaatggacatttccgtcgtttctcttgctgttcaagaacgatacggatttccgttcgattgttccaattttatctcgaatatgattgcggtcattaatgacgaaacatcattcaatgcattgttcacagcgttgccgggtgcgatattggaccttaaggccactagattttcagaagattaa

SEQ ID NO: 21 - protein, 2257 aa, unknown
  Synthetic Construct
MADHDEAATRSLLFISEMAKHLEISTEDVRSELGSKLLSRSTAITSQYEDHVVSNVLERITNFKELSKEIYIDQRLSDAEKTKLMQLWSPPYKLKFSKNSKDIGAHMYYRSMNEIATYRCYDLICGKEKNAPVNRDVLVKEVGAAVCKIVKYNRNSVHACTPNLTIDDTLRISNTQRSLESIIHDPTSPPHLVEKAKRYQSSGKYRCFRKSQHCKISSKFLVLAHCAYDCTLRQIANMMESAGAVRGIGFIHFSQKILSNLVEGSDNGLNWKIECRTYIDSRRNFGELGNLAGHAVSLYNSFRNKSDRIMNNINHRDFVIKFWFDNDYQNSYVHDLDTYLGIIRKSVCEADNGQTFMIQRKEEIGGLLFFEIIRPTIDIPPCVIHRMLPFSEPEDIIIHYYRLQNDPQGYHYHDLVPERLVCPKKFFEKLYYYLFCLPEGKFTVQNAVIMASTMASRTVINGTSVSQPYNLSINVIDKVSHAAYFIVYCRRYDLMLTLKKLKNFEDIRRNPTMYNRLCVLLRRVRNYVVGAPFEDLKTESTFDDAVDNATCSEANEIATKHSLNIIQWMMKLFRVNNRYKVDFFPITRVVSIEEDIQTFKAVEFGLPKFDEPVDDDSLRKIIKEKLHIDHVDVDKCTVSDTPCKCDLVPYHNNYEKRCVLLCFCNKRNISLNELQLSLYKSKYFEALFSTTKTKYHESIFGDKADIILFELIACVYNVNICLHTELKEIFHDVRSDETYHFMIKDNHCYELREKPSVRPFEFLPVPDKVNLLQNNLREAYSRPKAEKYKLRSVVVDDHHPYVCRSALKLLEIDGSYGVVKHGNVCEISAAPGSWIQYCHINHSHSKLFYTYFIEGNDFLYDHEDLNCLCESTSGDVTSPEFFQCFTVEAEKSGRFDTLLSDAVIMSSTEDHVDVERFTNYQNAFFLNLKEWVRDNGNIVFKSFADISISDTVNTVLNHFENVYFVKPNFSAALSTEYYIIGKNFLPETADEIPERKFFSIPSLVMNKVLRTANLFLKGKYPPQKKFVLPAVNPSVTTFPDVPAPSAPVEIAEDLAVLPNENDSFEDKVQKVINSLEFFDVDRADIEIVHEDTESFHHVHDVEISLHDSAMLGERNDYIIHPCPALKIDMSVVNYSEAVARIHSVSYKINSFRLKVKFDLTGVSDETVSSSLLTHIKERYSRHKLLIRTNYRECSVNISAFEKSTTEYIAYTRLVKSCNLSTYRHWYGQLKMNDFVVSMTIRRNVSMDTQNISYMQGCDFRFKHEKSQDEYTHCYCGETDCFIPFDEKLPDRWYLVGDYTAKMFDDALVEKVARIDLSKLKDVQFVLVQGVAGHGKTHEIVSKHTPSLRSCRGDLLVTPTIAGKKVIMERTANLHKLEIDSLDISSYRTVTSFLVKPTVHKYNTVYFDEAIMVHVALVIAVAYYSGAKTVYMYGDVAQIPAHSRLGSFDFNYHAPQKLFNAQHIRNKSYRIPADVAAALNPVYVDCHSQFGQSTGITTVSTVARSLNVVLINDVSEMKRHYREGVKYLAFTHTTANELNRLSSEFSASTIAAFQGSESKEVAIVRTSVSEADQMYNNINLCVTALTRHTLKLTYYTCCHKGDFLKKTIESTKALSDLAIKNFSTSINAGSVTNNEYVPMIDKPSVSRFFKSREKYSHSFTIVEHENVVSEKEFAYKLSKINNDIFVRKSIFKKFSMSELAKWIRKISPHIKQVYVKVYNEPFENNPIIIDIAEEYKVRNALTTEVSEHLEPINEVELITPIPVYPCMQLKPCLETLREFMSSLYPDQMYVNTDFDAYFVHTNDIDYTLSDTTLSMLWDRPHVRKYDCLTPWLSTPAPARRDVSFREILLGLMKRNMNPPQMLENTAPDDAAMHLMQSISSKAFIRGWKSVISEMLPIVPTTESIVRWLEKQDRSVLKSMMHDIPLWIATITRCSLSLKRNPKVRITPNAISIYDSVQTITCHPKFLNAYFCPIIDEVMDRFRKVLLPWFLIYTKENTESFSVKCSRAYAKYGKLGLFAGDDSFLINGIKMKEADISKCDKSELLLALKFLCMLLENFGVPEPSVALYYCMMYYRICSDPSNKITVSFTPQMESGSPATFFGNTTYCMAVILSVVDFETFEYTPRFEKFSMMFNLEVKEFKYDNPYFCSKFIVIDDLRFKFLPDPVKILIKLGRKDLKNFSHLKEFHTSLKDLVAEYKCVMDISVVSLAVQERYGFPFDCSNFISNMIAVINDETSFNALFTALPGAILDLKATRFSED

The invention claimed is:

1. A nucleic acid expression vector comprising 5' to 3' (a) Negevirus 5'UTR, (b) Negevirus ORF1, (c) heterologous nucleic acid, and (d) Negevirus 3'UTR.

2. The expression vector of claim 1, further comprising a Negevirus ORF2 3' to Negevirus ORF 1 and 5' to the heterologous nucleic acid.

3. The expression vector of claim 1, further comprising a 5'cap.

4. The expression vector of claim 1, wherein the heterologous nucleic acid encodes an insecticidal polypeptide.

5. The expression vector of claim 1, wherein the heterologous nucleic acid is under the control of a heterologous promoter.

6. The nucleic acid expression vector of claim 1 encoding a Negevirus nucleic acid having a consensus sequence of SEQ ID NO: 1.

7. A method for producing a recombinant Negevirus comprising (a) inserting an expression vector of claim 1 into an isolated eukaryotic cell, and (b) incubating the eukaryotic cell expressing a recombinant Negevirus genome under conditions such that a recombinant Negevirus particle is formed.

8. A kit for producing a recombinant Negevirus comprising an expression vector of claim 1 and at least one cell culture reagent.

\* \* \* \* \*